US009874570B2

(12) United States Patent
Charretier et al.

(10) Patent No.: US 9,874,570 B2
(45) Date of Patent: Jan. 23, 2018

(54) METHOD OF DETECTING AT LEAST ONE MECHANISM OF RESISTANCE TO CEPHALOSPORINS BY MASS SPECTROMETRY

(71) Applicant: BIOMERIEUX, INC., Durham, NC (US)

(72) Inventors: Yannick Charretier, Courzieu (FR); Jean-Philippe Charrier, Tassin la demi-lune (FR); Christine Franceschi, Meximieux (FR); Gilles Zambardi, Chezeneuve (FR); Tiphaine Cecchini, Saint-Genis les Ollieres (FR); Elodie Degout-Charmette, Tossieux (FR)

(73) Assignee: BIOMERIEUX, INC., Durham, NC (US)

( * ) Notice: Subject to any disclaimer, the term of this patent is extended or adjusted under 35 U.S.C. 154(b) by 0 days.

(21) Appl. No.: 15/295,061

(22) Filed: Oct. 17, 2016

(65) Prior Publication Data
US 2017/0052198 A1 Feb. 23, 2017

Related U.S. Application Data

(62) Division of application No. 14/111,118, filed as application No. PCT/EP2012/057322 on Apr. 20, 2012, now Pat. No. 9,506,932.

(60) Provisional application No. 61/477,907, filed on Apr. 21, 2011.

(51) Int. Cl.
*A61K 38/00* (2006.01)
*G01N 33/68* (2006.01)

(52) U.S. Cl.
CPC ... *G01N 33/6851* (2013.01); *G01N 2333/986* (2013.01)

(58) Field of Classification Search
CPC .... A61K 38/00; C07K 14/47; C07K 14/4702; C07K 14/4746; C07K 2319/00
See application file for complete search history.

(56) References Cited

U.S. PATENT DOCUMENTS

| 2004/0229283 A1 | 11/2004 | Gygi et al. |
| 2007/0006950 A1 | 1/2007 | Okada et al. |
| 2007/0269895 A1 | 11/2007 | Aebersold et al. |
| 2011/0245105 A1 | 10/2011 | Citri |
| 2012/0245128 A1 | 9/2012 | Haag et al. |
| 2012/0264156 A1 | 10/2012 | Beaulieu et al. |

FOREIGN PATENT DOCUMENTS

| WO | 2005/098071 A1 | 10/2005 |
| WO | 2006/128492 A1 | 12/2006 |
| WO | 2008/066629 A2 | 6/2008 |
| WO | 2008/145763 A1 | 12/2008 |
| WO | 2011/045544 A2 | 4/2011 |

OTHER PUBLICATIONS

Kruger et al. Infections with Nontyphoidal *Salmonella* Species Producing TEM-63 or a Novel TEM Enzyme, TEM-131, in South Africa. Antimicrobial Agents and Chemotherapy, Nov. 2004. vol. 48, No. 11. pp. 4263-4270.*
Sep. 4, 2014 Office Action issued in U.S. Appl. No. 14/111,118.
Jan. 3, 2014 Office Action issued in U.S. Appl. No. 13/502,020.
May 15, 2014 Office Action issued in U.S. Appl. No. 13/502,020.
Sauer, Sascha, et al., "Classification and Identification of Bacteria by Mass Spectrometry and Computational Analysis," vol. 3, Issue 7, Jul. 2008, pp. 1-10.
Dec. 5, 2014 Office Action issued in U.S. Appl. No. 14/111,083.
Apr. 24, 2015 Office Action issued in U.S. Appl. No. 14/111,118.
Ahmet et al., "Pyrolysis Mass Spectrometry of Cephalosporin-Resistant Enterobacter Cloacae," Journal Hospital Infection, 1995, vol. 31, pp. 99-104.
Bush, Extended-Spectrum Beta-Lactamases in North America, 1987-2006, Clin Microbial Infect 2008, vol. 14 (Suppl 1), pp. 134-143.
Hope et al., Efficacy of Practised Screening Methods for Detection of Cephalosporin-Resistant Enterobacteriaceae. J Antimicrob Chemotherapy 2007, vol. 59, pp. 110-113.
Moosdeen, "The Evolution of Resistance to Cephalosporins," CID 1997, pp. 487-493.
ExPaSy Peptidecutter for KPC-1—http://web.expasy.org/cgi-bin/peptide_cutter/peptidecutter.pl, 2 pgs., Jun. 8, 2015.
Savini et al., "Bacillus Cereus Heteroresistance to Carbapenems in a Cancer Patient," J. Hospital Infection, pp. 288-289, 2009.
Yigit et al., "Novel Carbapenem-Hydrolyzing Beta-Lactamase, KPC-1, from a Carbapenem-Resistant Strain of Klebsiella Pneumoniae," Antimicrobial Agents and Chemotherapy, vol. 45, No. 4, pp. 1151-1161, 2001.
Yigit et al., "Novel Carbapenem-Hydrolyzing Beta-Lactamase, KPC-1, from a Carbapenem-Resistant Strain of Klebisella Pneumoniae," Author's Correction, Antimicrobial Agents and Chemotherapy, vol. 52, No. 2, p. 809, 2008.
Kulkarni et al., "Use of Impipenem to Detect KPC, NDM, OXA, IMP, and VIM Carbapenemase Activity from Gram-Negative Rods in 75 Minutes Using Liquid Chromatography-Tandem Mass Spectrometry," JCM, vol. 52, No. 7, pp. 2500-2505, Jul. 2014.
Jun. 11, 2015 Office Action issued in U.S. Appl. No. 14/111,083.
Beccerril et al., "Combination of Analytical and Microbiological Techniques to Study the Antimicrobial Activity of a New Active Food Packaging Containing Cinnamon or Oregano Against *E. Coli* and *S. Aureus*," Anal Bioanal Chem, vol. 388, pp. 1003-1011, 2007.

(Continued)

*Primary Examiner* — Marcela M Cordero Garcia
(74) *Attorney, Agent, or Firm* — Oliff PLC

(57) ABSTRACT

The present invention pertains to a method of detection, by mass spectrometry, of at least one marker of at least one mechanism of resistance to at least one antimicrobial, resistance of at least one microorganism contained in a sample, characterised in that the antimicrobial is a cephalosporin, and said resistance markers are proteins or peptides. Preferably, said proteins or peptides are proteins from said microorganism.

5 Claims, No Drawings

(56) References Cited

OTHER PUBLICATIONS

Kuhn et al., "Quantification of C-Reactive Protein in the Serum of Patients with Rheumatoid Arthritis Using Multiple Reaction Monitoring Mass Spectrometry and 13C-Labeled Peptide Standards," Proteomics, vol. 4, pp. 1175-1186, 2004.
Keller et al., "A Uniform Proteomics MS/MS Analysis Platform Utilizing Open XML File Formats," Molecular Systems Biology, vol. 1, pp. 1-8, 2005.
Sep. 23, 2015 Office Action issued in U.S. Appl. No. 13/502,020.
Jan. 4, 2016 Office Action issued in U.S. Appl. No. 14/111,118.
Mar. 11, 2016 Office Action issued in U.S. Appl. No. 14/111,083.
U.S. Appl. No. 13/502,020, filed Jun. 29, 2012 in the name of Beaulieu et al.
Jul. 15, 2016 Notice of Allowance issued in U.S. Appl. No. 14/111,118.
Anhalt, J. et al. "Identification of Bacteria Using Mass Spectrometry." Analytical Chemistry, Feb. 1975, pp. 219-225, vol. 47, No. 2.
Oct. 11, 2012 International Search Report issued in International Patent Application No. PCT/EP2012/057323.
Jun. 14, 2011 International Search Report issued in International Patent Application No. PCT/FR2010/052181.
May 6, 2013 International Search Report issued in International Patent Application No. PCT/EP2012/057322.
Oct. 11, 2012 Written Opinion issued in International Application No. PCT/EP2012/057323.
May 6, 2013 Written Opinion issued in International Application No. PCT/EP2012/057322.
Jun. 14, 2011 Written Opinion issued in International Application No. PCT/FR2010/1052181.
U.S. Appl. No. 14/111,083, filed Oct. 10, 2013 in the name of Charretier et al.
Savinova, T.A. et al. Abstract of "A mass-spectrometric analysis of genetic markers of S. pneumonia resistance to β-lactam antibiotics." XP00268431, Database accession No. NLM20882772, Database Medline, 2010, US National Library of Medicine, Bethesda, MD.
Seng, P. et al. "Ongoing Revolution in Bacteriology: Routine Identification of Bacteria by Matrix-Assisted Laser Desorption Ionization Time-of-Flight Mass Spectrometry." Clinical Infectious Diseases, Aug. 2009, pp. 543-551, vol. 49, Infectious Diseases Society of America.
Stahl-Zeng, J. et al. "High Sensitivity Detection of Plasma Proteins by Multiple Reaction Monitoring of N-Glycosites." Molecular & Cellular Proteomics, Jul. 2007, pp. 1809-1817, vol. 6, No. 10, The American Society for Biochemistry and Molecular Biology, Inc.
Takao, T., et al. "Identity of molecular structure of Shiga-like toxin I (VTI) from *Escherichia coli* 0157 : H7 with that of Shiga toxin." Microbial Pathogenesis, 1988, pp. 357-369, 5(5).
Teng, C.H. et al. "Gold Nanoparticles as Selective and Concentrating Probes for Samples in MALDI MS Analysis." Analytical Chemistry, Aug. 2004, pp. 4337-4342, vol. 76, No. 15, American Chemical Society.
Vaidyanathan, S. et al. "Discrimination of Aerobic Endospore-forming Bacteria via Electrospray-Ionization Mass Spectrometry of Whole Cell Suspensions." Analytical Chemistry, Sep. 2001, pp. 4134-4144, vol. 73, No. 17, American Chemical Society.
Wang, K.Y. et al. "Multiplexed Immunoassay: Quantitation and Profiling of Serum Biomarkers Using Magnetic Nanoprobes and MALDI-TOF MS." Analytical Chemistry, Aug. 2008, pp. 6159-6167, vol. 80, No. 16, American Chemical Society.
Wybo, I. et al. "Differentiation of cfiA-Negative and cfiA-Positive Bacteroides fragilis Isolates by Matrix-Assisted Laser Desorption Ionization-Time of Flight Mass Spectrometry." Journal of Clinical Microbiology, May 2011, pp. 1961-1964, vol. 49, No. 5, American Society for Microbiology.
Zheng, K. "Elucidation of peptide metabolism by on-line immunoaffinity liquid chromatography mass spectrometry." Rapid Communications in Mass Spectrometry, 2000, pp. 261-269, vol. 14, John Wiley & Sons, Ltd.

Majcherczyk P., et al. "The discriminatory power of MALDI-TOF mass spectrometry to differentiate between isogenic teicoplanin-susceptible and teicoplanin-resistant strains of methicillin-resistant *Staphylococcus aureus*", Fems Microbiol Letters, 2006, pp. 233-239, 255(2).
Manes, N. et al. "Targeted Protein Degradation by *Salmonella* under Phagosome-mimicking Culture conditions Investigated Using Comparative Peptidomics." Molecular & Cellular Proteomics, Jan. 2007, pp. 717-727, vol. 6, No. 4, MCP Papers in Press.
Marinach, C. et al. "MALDI-TOF MS-based drug susceptibility testing of pathogens: The example of Candida albicans and fluconazole." Proteomics, 2009, pp. 4627-4631, 9(20).
Mazzeo, M., et al. "Matrix-assisted laser desorption ionization-time of flight mass spectrometry for the discrimination of food-borne microorganisms", Applied and Env. Microbio., 2006, pp. 1180-1189, 72(2).
Mead, J. et al. "MRMaid, the Web-based Tool for Designing Multiple Reaction Monitoring (MRM) Transitions." Molecular & Cellular Proteomics, 2009, pp. 696-705, vol. 8, No. 4, The American Society for Biochemistry and Molecular Biology, Inc.
Melanson, J., et al. "Targeted comparative proteomics by liquid chromatography/matrix-assisted laser desorption/ionization triple-quadruple mass spectrometry." Rapid Communications in Mass Spectrometry, 2006, pp. 904-910, 20(5).
Nandakumar, R. et al. "Proteomic analysis of endodontic infections by liquid chromatography-tandem mass spectrometry." Oral Microbiology and Immunology, 2009, pp. 347-352, vol. 24, John Wiley & Sons, Ltd.
Pratt, J. et al. "Multiplexed absolute quantification for proteomics using concatenated signature peptides encoded by QconCAT genes." Nature Protocols, 2006, pp. 1029-1043, vol. 1, No. 2, Nature Publishing Group.
Qian, J., et al, "MALDI-TOF mass signatures for differentiation of yeast species, strain grouping and monitoring of morphogenesis markers", Analytical and Bioanal. Chemistry, 2008, pp. 439-449, 392(3).
Keshishian, H. et al. "Quantitative, Multiplexed Assays for Low Abundance Proteins in Plasma by Targeted Mass Spectrometry and Stable Isotope Dilution." Molecular & Cellular Proteomics, 2007, pp. 2212-2229, vol. 6, No. 12, The American Society for Biochemistry and Molecular Biology, Inc.
Kondo, F., et al. "Identification of Shiga toxins in Shiga toxin-producing *Escherichia coli* using immunoprecipitation and high-performance liquid chromatography-electrospray ionization mass spectrometry." The Analyst, 2003, pp. 1360-1364, 128(11).
Krishnamurthy, T. et al. "Rapid Identification of Bacteria by Direct Matrix-assisted Laser Desorption/Ionization Mass Spectrometric Analysis of Whole Cells." Rapid Communications in Mass Spectrometry, 1996, pp. 1992-1996, vol. 18, John Wiley & Sons, Ltd.
Li, M., et al. "Comparative proteomic analysis to identification of extracellular virulence factors of enterohemorrhagic *Escherichia coli* (EHEC) and enteropathogenic *Escherichia coli* (EPEC)." Faseb Journal, 2005, A1388, 19(5).
Lin, Y.C. et al. "Differences in carbapenem resistance genes among Acinetobacter baumannii, Acinetobacter genospecies 3 and Acinetobacter genospecies 13TU in Taiwan." International Journal of Antimicrobial Agents, 2010, pp. 439-443, vol. 35.
Lin, Y.S. et al. "Affinity Capture Using Vancomycin-Bound Magnetic Nanoparticles for the MALDI-MS Analysis of Bacteria." Analytical Chemistry, Mar. 2005, pp. 1753-1760, vol. 77, No. 6, American Chemical Society.
López-Ferrer, D. et al. "Ultra Fast Trypsin Digestion of Proteins by High Intensity Focused Ultrasound." Journal of Proteome Research, 2005, pp. 1569-1574, vol. 4, American Chemical Society.
López-Ferrer, D. et al. "On-line Digestion System for Protein Characterization and Proteome Analysis." Analytical Chemistry, Dec. 2008, pp. 8930-8936, vol. 80, No. 23, American Chemical Society.
Mainardi, J. et al. "Resistance to cefotaxime and peptidoglycan composition in Enterococcus faecalis are influenced by exogenous sodium chloride." Microbiology, 1998, pp. 2679-2685, vol. 144, SGM.

(56) References Cited

OTHER PUBLICATIONS

Fortin, T. et al. "Clinical Quantitation of Prostate-specific Antigen Biomarker in the Low Nanogram/Milliliter Range by Conventional Bore Liquid Chromatography-Tandem Mass Spectrometry (Multiple Reaction Monitoring) Coupling and Correlation with ELISA Tests." Molecular & Cellular Proteomics, pp. 1006-1015, vol. 8, No. 5, The American Society for Biochemistry and Molecular Biology, Inc.

Fox, A. et al. ed., "Analytical Microbiology Methods: Chromatography and Mass Spectrometry." 1990, Plenum Press, New York, NY.

Fusaro, V. et al. "Prediction of high-responding peptides for targeted protein assays by mass spectrometry." Nature Biotechnology, Feb. 2009, pp. 190-198, vol. 27, No. 2, Nature America, Inc.

Gaskell, S. "Electrospray: Principles and Practice." Journal of Mass Spectrometry, 1997, pp. 677-688, vol. 32, John Wiley & Sons, Ltd.

Gröbner, S. et al. "Emergence of carbapenem-non-susceptible extended-spectrum β-lactamase-producing Klebsiella pneumonia isolates at the university hospital of Tübingen, Germany." Journal of Medical Microbiology, 2009, pp. 912-922, vol. 58, SGM.

Han, B. et al. "Proteomics: from hypothesis to quantitative assay on a single platform. Guidelines for developing MRM assays using ion trap mass spectrometers." Briefings in Functional Genomics and Proteomics, Jun. 2008, pp. 340-354, vol. 7, No. 5, Oxford University Press, Oxford, UK.

Hernychova, L. et al. "Detection and Identification of Coxiella bumetii Based on the Mass Spectrometric Analyses of the Extracted Proteins." Analytical Chemistry, Sep. 2008, pp. 7097-7104, vol. 80, No. 18, American Chemical Society.

Ho, K., et al. "Using Biofunctionalized Nanoparticles to Probe Pathogenic Bacteria", Anal. Chem., 2004,pp. 7162-7168, 76.

Hofstadler, S. et al. "TIGER: the universal biosensor." International Journal of Mass Spectrometry, 2005, pp. 23-41, vol. 242.

Ding, D. et al "Identification of protein components and quantitative immunoassay for SEC2 in Staphylococciinjection." Journal of Pharmaceutical and Biomedical Analysis, 2009, pp. 79-85, vol. 50.

Ecker, D. et al. "Ibis T5000: a universal biosensor approach for microbiology." Nature Reviews Microbiology, Jun. 2008, pp. 553-558, vol. 6, No. 7, Nature Publishing Group.

Everley, R. et al. "Characterization of Clostridium species utilizing liquid chromatography/mass spectrometry of intact proteins." Journal of Microbiological Methods, pp. 152-158, Feb. 2009, vol. 77.

Camara et al, "Discrimination between wild-type and ampicillin-resistant *Escherichia coli* by matrix-assisted laser desorption/ionization time-of-flight mass spectrometry." Analytical and Bioanal. Chemistry, 2007, pp. 1633-1638,389 (5).

Carbonnelle et al, "Rapid identification of *Staphylococci* isolated in clinical microbiology laboratories by matrix-assisted laser desorption ionization-time of flight mass spectrometry", Journal of Clinical Microbio., 2007, pp. 2156-2161, 45(7).

Chen, W. et al. "Functional Nanoparticle-Based Proteomic Strategies for Characterization of Pathogenic Bacteria." Analytical Chemistry, Dec. 2008, pp. 9612-9621, vol. 80, No. 24, American Chemical Society.

Claydon, M. et al. "The rapid identification of intact microorganisms using mass spectrometry." Nature Biotechnology, Nov. 1996, pp. 1584-1586, vol. 14.

Dare et al. "*Staphylococci* speciation and Panton-Valentine leukocidin detection by matrix assisted laser desorption ionisation time-of-flight mass spectrometry", Intern. Journal of Antimicrobial Agents, 2007, pp. 103-104, 29(2).

Desiere, F. et al. "The PeptideAtlas project." Nucleic Acids Research, 2006, pp. D655-D658, vol. 34, Database Issue, Oxford University Press, Oxford, UK.

Bundy,J. et al. "Lectin-Based Affinity Capture for MALDI-MS Analysis of Bacteria." Analytical Chemistry, Apr. 1999, pp. 1460-1463, vol. 71, No. 7, American Chemical Society.

Bush, K. et al. "Updated Classification of β-Lactamases." Antimicrobial Agents and Chemotherapy, Mar. 2010, pp. 969-976, vol. 54, No. 3, American Society for Microbiology.

Bernardo et al. "Identification of *Staphylococcus aureus* exotoxins by combined sodium dodecyl sulfate gel electrophoresis and matrix-assisted laser desorption/ionization-time of flight mass spectrometry." Proteomics, 2002, pp. 740-746, 2(6).

Anderson, L. et al. "Quantitative Mass Spectrometric Multiple Reaction Monitoring Assays for Major Plasma Proteins." Molecular & Cellular Proteomics, 2006, pp. 573-588, vol. 5, No. 4. The American Society for Biochemistry and Molecular Biology, Inc.

Brun, V. et al. "Isotope-labeled Protein Standards Toward Absolute Quantitative Proteomics." Molecular & Cellular Proteomics, 2007, pp. 2139-2149, vol. 6, No. 12, The American Society for Biochemistry and Molecular Biology, Inc.

Bernardo et al, "Identification and discrimination of *Staphylococcus aureus* strains using matrix-assisted laser desorption/ionization-time of flight mass spectrometry." Proteomics, 2002, pp. 747-753,2 (6).

Fenselau, C. et al. "Identification of β-Lactamase in Antibiotic-Resistant Bacillus cereus Spores." Applied and Environmental Microbiology. Feb. 2008, pp. 904-906, vol. 74, No. 3, American Society for Microbiology.

\* cited by examiner

US 9,874,570 B2

METHOD OF DETECTING AT LEAST ONE MECHANISM OF RESISTANCE TO CEPHALOSPORINS BY MASS SPECTROMETRY

This application is a divisional application of U.S. patent application Ser. No. 14/111,118, filed Dec. 23, 2013, which is in turn a U.S. National Stage of International Application No. PCT/EP2012/057322, filed Apr. 20, 2012, which claims priority from U.S. Provisional Application No. 61/477,907, filed Apr. 21, 2011. The disclosure of the prior applications is hereby incorporated by reference herein in their entirety.

The present invention relates to the field of microbiology. More precisely, the invention relates to the detection of at least one mechanism of resistance to cephalosporins of at least one microorganism from a sample by using mass spectrometry.

Since Pasteur's discovery of microbes, microorganisms have been studied by microscopy and biochemical analyses. These conventional methods are often long and tedious, and analytical alternatives were sought very early on. This is why the analysis of bacteria by mass spectrometry was initiated from 1975 by J. Anhalt and C. Fenselau [1].

This preliminary work was followed by the study of fatty acids from the wall of the microorganisms using gas chromatography combined with mass spectrometry (GC-MS) [2]. This method was popularised under the English term FAME, standing for Fatty Acid Methyl Ester. It currently constitutes a reference method for taxonomic studies. However, its use remains limited to certain specialised laboratories dealing with the treatment of the sample by saponification, hydrolysis and derivation. In 1996, the works by M. Claydon et al. [3] as well as by T. Krishnamurthy and P. Ross [4] demonstrated the possibility of identifying different bacterial species with a MALDI-TOF mass spectrometer (English acronym for Matrix Assisted Laser Desorption Ionization—Time Of Flight). The analysis combines the acquisition of a mass spectrum and the interpretation of expert software. It is extremely simple and can be carried out in a few minutes. However it has only been making it into medical analysis laboratories fairly recently [5]. Its clinical use is currently limited to the identification of bacteria and yeast species. It is not routinely used to identify resistances to antimicrobials.

Yet the identification of resistances to antimicrobials such as antibiotics is an essential element in ensuring optimal patient care.

Other mass spectrometry methods, particularly in tandem, have been proposed to meet these needs. By way of example, it is possible to cite the work of C. Fenselau et al. for identifying β-Lactamase with a quadripole-TOF (Q-TOF) [6].

However these research results are not applicable to routine clinical use. They were obtained with research instruments requiring highly qualified personnel. The analysis times, often greater than one hour per sample, are incompatible with the workload of a microbiological analysis laboratory.

More recently, S. Hofstadler et al. [7] proposed a method combining a microbial genome amplification by PCR to a detection of the PCR products by electrospray-TOF (ESI-TOF). This method is now fully automated [8]. However, it requires a PCR amplification with the flaws inherent in molecular biology, namely extraction yield, cost of the probes, etc.

In this context, the objective of the present invention is to propose a method of detecting mechanisms of resistance to cephalosporins which makes it possible to overcome the disadvantages of the prior art methods, namely providing an inexpensive method, without reagents specific to each species, particularly compared to molecular biology methods, which gives a result in a short amount of time, less than one hour, and which can be used in routine clinical work, without requiring highly qualified personnel.

To this end, the invention proposes a new method of detecting, by mass spectrometry, at least one mechanism of resistance to at least one antimicrobial of at least one microorganism from a sample, characterised in that the antimicrobial is a cephalosporin and in that proteins and/or peptides are detected as markers of said mechanism of resistance to at least one cephalosporin-class antibiotic.

Advantageously, markers of resistance to several different antimicrobials can be detected simultaneously.

As indicated in application PCT/FR2010/052181, markers of type and/or virulence of said microorganisms can be detected in the same way by mass spectrometry prior to or at the same time as the detection of the resistance mechanism markers.

Markers of resistance to at least one cephalosporin-class antimicrobial is understood to mean molecules of protein origin which are characteristic of said properties.

Cephalosporins are antibiotics belonging to the beta-lactam family. They are usually classified in several subclasses:
  first-generation cephalosporins, such as cefazolin, cephalothin, cefaclor, cephalexin, which are broken down by the beta-lactamases of groups 1 and 2b, 2br, 2be, 2ber
  second-generation cephalosporins, such as cefamandole, cefpodoxime, cefuroxime, which are broken down by the beta-lactamases of groups 1, 2be, 2ber
  third-generation cephalosporins, such as cefotaxime, ceftazidime, ceftriaxone, cefixime, which are broken down by the beta-lactamases of groups 1, 2be, 2ber, even though they are more stable than the first-generation and second-generation cephalosporins
  fourth-generation cephalosporins, such as cefepime and cefpirome, which are broken down by the beta-lactamases of groups 2be and 2ber
  cephalosporins exhibiting anti-MRSA activity such as ceftaroline and ceftobiprole, which are broken down by the beta-lactamases of groups 2be and 2ber
  cephamycins, such as cefoxitin, cefotetan, cefmetazole, which are broken down by the beta-lactamases of group 1

Determination of the resistance to at least one antimicrobial is understood to mean determining the susceptibility of a microorganism to being destroyed by an antimicrobial. The proteins involved in the resistance mechanisms will differ depending on the family and the species.

The nomenclature of the beta-lactamases, beta-lactam-resistant bacterial enzymes, is not standardised. They are either classified in four molecular classes (A to D) on the basis of their primary structure, or in functional groups on the basis of the target substrates and their resistance to inhibitors (for an overview, see [9] Bush and Jacoby, Antimicrobial Agents and Chemotherapy, 2010; 54 (3): 969-976). For molecular classification, sequencing techniques have made more precise classification possible: for example, 183 variants of the TEM protein have been described (labelled TEM-i, with i being between 1 and 183). For the functional classification, Bush and Jacoby (supra) have proposed new functional subgroups:

the group 1 enzymes are cephalosporinases belonging to the molecular class C. ACC, ACT, MIR, MOX, DHA, CMY and FOX are plasmid-borne enzymes, belonging to this subgroup.

the group 2 enzymes belong to molecular classes A and D. This group is itself subdivided into subgroups: 2a, 2b, 2be, 2br, 2ber, 2c, 2ce, 2d, 2de, 2df, 2f, etc. CTX-M (2be), SHV (2b, 2be or 2br), PER (2be), VEB (2be) and TEM (2b, 2be, 2br or 2ber) are enzymes belonging to this group.

The subgroup 2a corresponds to beta-lactamases which hydrolyse benzylpenicillin and penicillin derivatives, but which do not hydrolyse cephalosporins, carbapenems or monobactams.

The subgroup 2b corresponds to broad-spectrum beta-lactamases which hydrolyse first-generation penicillins and cephalosporins such as cephaloridine and cephalothin, and which are inhibited by clavulanic acid, sulfobactam, or tazobactam. The variants TEM-1, TEM-2 and SHV-1 belong to this subgroup.

The subgroup 2b corresponds to extended-spectrum beta-lactamases (ESBL) which are also inhibited by clavulanic acid, sulfobactam, or tazobactam. These enzymes, in addition to the properties of subgroup 2b, hydrolyse at least one oxyimino-beta-lactam such as cefotaxime or ceftazidime, and monobactams such as aztreonam. This subgroup contains numerous variants of TEM and SHV, variants of PER and VEB, as well as CTX-M, BEL-1, BES-1, SFO-1, TAL-1 and TAL-2.

The subgroup 2br corresponds to beta-lactamases from the subgroup 2b which are insensitive to inhibition by clavulanic acid, sulfobactam or tazobactam. This subgroup contains variants of the enzymes TEM and SHV.

The subgroup 2ber corresponds to beta-lactamases from the subgroup 2be which are insensitive to inhibition by clavulanic acid, sulfobactam or tazobactam. This subgroup contains TEM variants.

The subgroup 2ce is characterised by its ability to hydrolyse carbenicillin or ticarcillin, as well as cefepime and cefpirome. CARB-10 is part of this subgroup.

The subgroup 2d includes the OXA beta-lactamases capable of hydrolysing cloxacillin or oxacillin. The OXAs (or oxacillinases) correspond to class-D beta-lactamases, according to their primary sequence, and they can confer resistances to cephalosporins or to cephalosporins and to carbapenems (Poirel et al., 2010, Antimicrobio. Agents Chemother., 54:24-38).

The subgroup 2de includes OXAs having an extended spectrum extended to oxy-imino-beta-lactams, but not to carbapenems.

The subgroup 2df includes OXAs having a spectrum extended to carbapenems.

The subgroup 2e corresponds to extended-spectrum cephalosporinases, which are inhibited by clavulanic acid or tazobactam.

The subgroup 2f corresponds to carbapenemases such as SME, KPC or certain variants of GES. The first GES beta-lactamase was isolated in 1998 in French Guiana (Poirel et al., 2000, Antimicrobio. Agents Chemother., 43:622-632). This enzyme (GES-1) conferred an ESBL resistance (subgroup 2be). The second isolate from a bacterium bearing a GES beta-lactamase was achieved in 2000 in South Africa (Poirel et al., 2001, Antimicrobio. Agents Chemother., 45: 2598-2603). This enzyme (GES-2) conferred a resistance to cephalosporins and to carbapenems such as imipenem (subgroup 2f).

The group 3 enzymes are metallo-beta-lactamases known for hydrolysing carbapenem-class antibiotics. The enzymes IMP, VIM, CAU, GOB or FEZ are part of this group.

The method of the invention can be employed to detect mechanisms of resistance to cephalosporins in bacteria. Thus, for example, as bacteria in which it is possible to seek a mechanism of resistance to cephalosporins according to the method of the invention, non-exhaustive mention may be made of:

the Enterobacteriaceae, using group 1 and group 2 proteins and peptides as a resistance marker;

non-fermenting bacteria (*Pseudomonas aeruginosa, Acinetobacter baumannii*)

etc.

It should further be noted that the strains known to be resistant to carbapenems are also resistant to cephalosporins and to penicillins. Therefore, a method of detecting a mechanism of resistance to carbapenems also makes it possible to detect a mechanism of resistance to cephalosporins and to penicillins.

The sample on which the method of the invention can be employed is any sample susceptible of containing a target microorganism. The sample can be of biological origin, either animal, vegetable or human. In this case it may correspond to a specimen of biological fluid (whole blood, serum, plasma, urine, cerebrospinal fluid, organic secretion, for example), a tissue specimen or isolated cells. This specimen can be used such as it is insofar as the markers of mechanisms of bacterial resistance to beta-lactams are available in the sample tested, or it can, prior to the analysis, undergo preparation by enrichment, extraction, concentration, purification, culturing, in accordance with methods known to the person skilled in the art.

The sample can be of industrial origin, or, according to a non-exhaustive list, can be an air specimen, a water specimen, a surface specimen, a part or a manufactured product, or a food product. Amongst the food samples, non-exhaustive mention can be made of a sample of a dairy product (yogurts, cheeses), of meat, of fish, of egg, of fruit, of vegetable, of water, of a beverage (milk, fruit juice, soda, etc.). These food samples can also come from sauces or ready meals. Finally, a food sample can come from an animal feed, such as animal meals.

Upstream of the detection by mass spectrometry, the sample to be analysed is preferably pre-treated to produce peptides from the entirety of the proteins present in the sample to fragment these proteins into peptides, for example by digestion with a proteolytic enzyme (protease), or by the action of a chemical reagent. In fact, the cleaving of the protein can be performed by a physico-chemical treatment, by a biological treatment or by a combination of the two treatments. Amongst the useable treatments, mention can be made of treatment by hydroxyl radicals, in particular with $H_2O_2$. Treatment by hydroxyl radicals results in a cutting of the peptide bonds which takes place randomly on any of the protein's peptide bonds. The hydroxyl radical concentration determines the number of cleavages performed, and therefore the length of the peptide fragments obtained. Other chemical treatments can also be used such as, for example, cyanogen bromide (CNBr) treatment which specifically splits the peptide bonds at the carboxyl group of the methionyl residues. It is also possible to perform partial acid cleaving at the aspartyl residues by heating a solution of proteins in trifluoroacetic acid to 1000° C.

Treatment of the proteins by enzymatic digestion is nevertheless preferred over physico-chemical treatment because it preserves more of the structure of the protein, and is easier to control. "Enzymatic digestion" is understood to mean the single or combined action of one or more enzymes under appropriate reaction conditions. The enzymes carrying out the proteolysis, which are called proteases, cut the proteins at specific locations. Each protease generally recognises a sequence of amino acids within which it always makes the same cut. Certain proteases recognise a single amino acid or a sequence of two amino acids between which they perform a cleavage, whereas other proteases only recognise longer sequences. These proteases can be endoproteases or exoproteases. Amongst the known proteases, mention may be made of the following as described in WO2005/098071:

specific enzymes such as trypsin which splits the peptide bond at the carboxyl group of the Arg and Lys residues, endolysin which cleaves the peptide bond of the —CO group of the lysines, chymotrypsin which hydrolyses the peptide bond at the carboxylic group of the aromatic residues (Phe, Tyr and Trp), pepsin which makes a cut at the $NH_2$ group of the aromatic residues (Phe, Tyr and Trp), the protease V8 from the V8 strain of *Staphylococcus aureus* which cleaves the peptide bond at the carboxylic group of the Glu residue;

the non-specific enzymes such as thermolysin from the bacteria *Bacillus thermoproteolyticus* which hydrolyses the peptide bond of the $NH_2$ group of hydrophobic amino acids (Xaa-The, Xaa-Ile, Xaa-Phe), subtilisin and pronase which are bacterial proteases which hydrolyse practically all the bonds and can transform the proteins into oligopeptides under controlled reaction conditions (enzyme concentration and duration of reaction).

Several proteases may be used simultaneously, if their modes of action are compatible, or they may be used successively. Within the framework of the invention, the digestion of the sample is preferably performed by the action of a protease enzyme, for example trypsin.

The generation of peptides using a chemical reagent or a protease can be obtained by means of a simple reaction in solution. It can also be performed with a microwave oven [10], or under pressure [11], or even with an ultrasound device [12]. In these three latter cases, the protocol will be much faster.

Amongst the peptides thus obtained, the peptides specific to the protein are referred to as proteotypic peptides. It is these which will be assayed by mass spectrometry. According to the invention, the markers of the mechanisms of bacterial resistance to cephalosporins are proteins from the bacterium in which the mechanisms of resistance to cephalosporins are to be sought. In particular, said proteins are digested into peptides, preferably by an enzyme, and more preferably by trypsin. Similarly, the sample containing protein markers characterising mechanisms of bacterial resistance to cephalosporins can also be pre-treated for the purposes of purification. This purification pretreatment can be employed before or after the peptide production step as described above.

The sample purification pretreatment is widely known to the person skilled in the art and may in particular employ the techniques of centrifugation, filtration, electrophoresis or chromatography. These separating techniques can be used alone or in combination with one another to obtain a multidimensional separation. For example, multidimensional chromatography can be used by combining separation by ion exchange chromatography with reversed-phase chromatography, as described by T. Fortin et al. [13], or H. Keshishian et al. [14]. In these publications, the chromatography medium can be in a column or in a cartridge (solid-phase extraction).

The electrophoretic or chromatographic fraction (or the retention time in monodimensional or multidimensional chromatography) of the proteotypic peptides is characteristic of each peptide, and employing these techniques therefore makes it possible to select the proteotypic peptide or peptides to be assayed. Such a fractionation of the produced peptides makes it possible to increase the specificity of the subsequent assay by mass spectrometry.

An alternative to the electrophoresis or chromatography techniques for the fractionation of the peptides consists in specifically purifying the N-glycopeptides ([15] and patent application WO 2008/066629). However, such a purification only makes it possible to quantify the peptides which have undergone an N-glycosylation post-translational modification. Not all proteins are glycosylated though, which therefore limits its use.

The mass spectrometry to be employed in the method of the invention is widely known to the person skilled in the art as a powerful tool for analysing and detecting different types of molecules. Generally, any type of molecule able to be ionised can be detected according to its molecular mass with the aid of a mass spectrometer. According to the nature of the molecule to be detected, whether of protein or metabolic origin, certain mass spectrometry technologies can be more suitable. Nevertheless, whatever mass spectrometry method is used for the detection, this latter includes a step of ionising the target molecule into so-called molecular ions, in the present case a step of ionising the characterising markers, and a step of separating the molecular ions obtained according to their mass.

All mass spectrometers therefore comprise:

an ionising source intended to ionise the markers present in the sample to be analysed, i.e. to confer a positive or negative charge upon these markers;

a mass analyser intended to separate the ionised markers, or molecular ions, according to their mass-to-charge ratio (m/z);

a detector intended to measure the signal produced either directly by the molecular ions, or by ions produced from molecular ions as detailed hereafter.

The ionisation step necessary for employing mass spectrometry can be performed via any method known to the person skilled in the art. The ionising source makes it possible to transform the molecules to be assayed into a gaseous and ionised state. An ionising source can be used either in positive mode to study the positive ions, or in negative mode to study the negative ions. Several types of sources exist and will be used depending on the result sought and the molecules analysed. In particular, mention may be made of:

electron ionisation (EI), chemical ionisation (CI) and desorption chemical ionisation (DCI)

fast atom bombardment (FAB), metastable atom bombardment (MAB) or ion bombardment (SIMS, LSIMS)

inductively coupled plasma (ICP)

atmospheric-pressure chemical ionisation (APCI) and atmospheric-pressure photoionisation (APPI)

electronebulisation or electrospray (ESI)

matrix-assisted laser desorption/ionisation (MALDI), surface-activated laser desorption/ionisation (SELDI) or desorption/ionisation on silicon (DIOS)

ionisation/desorption by interaction with metastable species (DART)

In particular, ionisation can be employed as follows: the sample containing the target molecules is introduced into an ionisation source, where the molecules are ionised in gaseous state and thus transformed into molecular ions which correspond to the initial molecules. An electrospray ionisation (ESI) source makes it possible to ionise a molecule by making it pass from a liquid state into a gaseous state. The molecular ions obtained therefore correspond to the molecules present in liquid state, with, in positive mode, one, two, or even three or more additional protons and therefore carry one, two, or even three or more charges. For example, when the target molecule is a protein, an ionisation of the proteotypic peptides obtained after fractionation of the target protein, by means of an electrospray source functioning in positive mode, leads to polypeptide ions in gaseous state, with one, two, or even three or more additional protons and which therefore carry one, two, or even three or more charges, and makes it possible to move from a liquid state to a gaseous state [16]. This type of source is particularly well suited when the target molecules or proteotypic peptides obtained are separated beforehand by reversed-phase liquid chromatography. Nevertheless, the ionisation yield of the molecules present in the sample may vary depending on the concentration and the nature of the different species present. This phenomenon leads to a matrix effect well known to the person skilled in the art.

A MALDI ionisation source will allow ionisation of the molecules from a solid-state sample.

The mass analyser in which the step of separating the ionised markers according to their mass-to-charge ratio (m/z) is performed is any mass analyser known to the person skilled in the art. Mention can be made of low-resolution analysers, quadripole or quadrupole (Q), 3D ion trap (IT) or linear ion trap (LIT), also called ion trap, and high-resolution analysers which make it possible to measure the exact mass of the analytes and which in particular use the magnetic sector linked to an electric sector, the time of flight (TOF), Fourier transform ion cyclotron resonance (FT-ICR), orbitrap.

The separation of the molecular ions depending upon their m/z ratio can be employed just once (single mass spectrometry or MS), or several successive MS separations can be conducted. When two successive MS separations are carried out, the analysis is called MS/MS or $MS^2$. When three successive MS separations are carried out, the analysis is called MS/MS/MS or $MS^3$, and more generally, when n successive MS separations are carried out, the analysis is called $MS^n$.

Amongst the techniques which employ several successive separations, SRM (Selected Reaction Monitoring) mode when detecting or assaying a single target molecule, or MRM (Multiple Reaction Monitoring) mode when detecting or assaying several target molecules are particular uses of $MS^2$ separation. Similarly the $MRM^3$ mode is a particular use of MS/MS/MS separation. This is referred to as targeted mass spectrometry.

In the case of a detection in single MS mode, it is the mass-to-charge ratio of the molecular ions obtained which is correlated to the target molecule to be detected.

In the case of detection in MS/MS mode, essentially two steps are added, compared to an MS assay, which are:
 a fragmentation of the molecular ions, then called precursor ions, to give ions called $1^{st}$ generation fragment ions, and
 a separation of the ions called $1^{st}$ generation fragment ions according to their mass $(m/z)_2$, the ratio $(m/z)_1$ corresponding to the ratio (m/z) of the precursor ions.

It is therefore the mass-to-charge ratio of the $1^{st}$ generation fragment ions thus obtained which is correlated to the target molecule to be detected. First-generation fragment ion is understood to be an ion derived from the precursor ion, following a fragmentation step and of which the mass-to-charge ratio m/z is different from the precursor ion.

The $(m/z)_1$ and $(m/z)_2$ pairs are called transitions and are representative of the characteristic ions to be detected.

The choice of the characteristic ions which are detected to be correlated to the target molecule is made by the person skilled in the art in accordance with the standard methods. Their selection will advantageously lead to the most sensitive, specific and robust assays possible, in terms of reproducibility and reliability. In the methods developed for the selection of proteotypic peptides $(m/z)_1$, and of the first-generation fragment $(m/z)_2$, the choice is essentially based on the intensity of the response. For more details, it is possible to refer to V. Fusaro et al. [17]. Commercially available software, such as the MIDAS and MRM Pilot software from Applied Biosystems or MRMaid [18] can be used by the person skilled in the art to allow him to predict all the possible transition pairs. He can also make use of a database called PeptideAtlas constructed by F Desiere et al. [19] to compile all of the MRM transitions of peptides described by the scientific community. This database PeptideAtlas is freely available on the internet. For non-protein molecules, it is also possible to use databases, such as, for example, the one accessible through the Cliquid software from the company Applied Biosystems (United States of America).

An alternative approach to selecting the proteotypic peptides $(m/z)_1$ and $(m/z)_2$ consists in using MS/MS fragmentation spectra obtained during other work. This work can be, for example, the phases of biomarker discovery and identification by proteomic analysis. This approach was proposed by Thermo Scientific during user conferences [18]. It makes it possible to generate a list of candidate transitions from the peptides identified through testing by the SIEVE (Thermo Scientific) software. Certain criteria were detailed by J. Mead et al. [18] for the choice of the ions $(m/z)_1$ and $(m/z)_2$ and are detailed hereafter:
 peptides with internal cleavage sites, i.e. with internal Lysine or Arginine, must be avoided, unless the Lysine or Arginine is followed by Proline,
 peptides with Aspargine or Glutamine must be avoided because they may deaminate,
 peptides with Glutamine or Glutamic Acid at the N-terminal must be avoided because they may cyclise spontaneously,
 peptides with Methionine must be avoided because they may be oxidised,
 peptides with Cysteine must be avoided because they may be non-reproducibly modified during a potential step of denaturation, reduction and blocking of the thiol functions,
 peptides with Proline may be considered to be favourable because they generally produce intense fragments in MS/MS with a very strong single peak. However, a very strong single fragment does not make it possible to validate the identity of the transition in a complex mixture. Indeed, only the simultaneous presence of several characteristic fragments makes it possible to verify that the precursor ion sought has actually been detected, the peptides having a Proline adjacent to the C-terminal (Position n−1) or in second position relative to the C-terminal (position n−2) should be avoided because, in this case, the size of the first-generation peptide fragment is generally considered to be too small to be sufficiently specific, the selection of fragments having a mass greater than the precursor should be given preference in order to promote specificity. To this end, it is necessary to select a dicharged precursor ion and select the most intense first-generation ion fragment having a mass greater than the precursor, i.e. a monocharged first-generation fragment ion.

The fragmentation of the selected precursor ions is performed in a fragmentation cell such as the triple quadripole model [20], ion trap model [21], or time-of-flight (TOF) model [22], which also make it possible to separate ions. The fragmentation or fragmentations will be conventionally performed by collision with an inert gas such as argon or nitrogen, within an electrical field, by photo-excitation or photo-dissociation using an intense light source, collision with electrons or radical species, by applying a potential difference, for example in a time-of-flight tube, or by any other activation mode. The characteristics of the electrical field determine the intensity and nature of the fragmentation. Thus, the electrical field applied in the presence of an inert gas, for example in a quadripole, determines the collision energy provided to the ions. This collision energy will be optimised, by the person skilled in the art, to increase the sensitivity of the transition to be assayed. By way of example, it is possible to vary the collision energy between 5 and 180 e$^-$V in q2 in an AB SCIEX QTRAP® 5500 mass spectrometer from the company Applied Biosystems (Foster City, United States of America). Similarly, the duration of the collision step and the excitation energy within, for example, an ion trap will be optimised by the person skilled in the art to lead to the most sensitive assay. By way of example, it is possible to vary this duration, called excitation time, between 0.010 and 50 ms and the excitation energy between 0 and 1 (arbitrary unit) in Q3 in an AB SCIEX QTRAP® 5500 mass spectrometer by the company Applied Biosystems.

Finally, the detection of the selected characteristic ions takes place in the conventional manner, particularly by means of a detector and a processing system. The detector collects the ions and produces an electrical signal whose intensity depends on the amount of ions collected. The signal obtained is then amplified such that it can be processed by computer. A computer data processing assembly makes it possible to transform the information received by the mass spectrum detector.

The principle of the SRM mode, or even of the MRM mode, is to specifically select a precursor ion, fragment it, and then specifically select one of its fragment ions. For such applications, triple quadripole or hybrid triple quadripole/ion trap devices are generally used.

In the case of a triple quadripole device (Q1q2Q3) used in MS$^2$ mode, with a view to assaying or detecting a target protein, the first quadripole (Q1) makes it possible to filter the molecular ions corresponding to the proteotypic peptides characteristic of the protein to be assayed and obtained during an earlier digestion step, depending on their mass-to-charge ratio (m/z). Only the peptides having the mass-to-charge ratio of the proteotypic peptide sought, which ratio is called $(m/z)_1$, are transmitted into the second quadripole (q2) and act as precursor ions for the subsequent fragmentation. The analyser q2 can fragment the peptides of mass-to-charge ratio $(m/z)_1$ into first-generation fragment ions. Fragmentation is generally obtained through collision of the precursor peptides with an inert gas, such as nitrogen or argon in q2. The first-generation fragment ions are transmitted into a third quadripole (Q3) which filters the first-generation fragment ions depending on a specific mass-to-charge ratio, called $(m/z)_2$. Only the first-generation fragment ions having the mass-to-charge ratio of a fragment characteristic of the sought proteotypic peptide $(m/z)_2$ are transmitted into the detector in order to be detected, or even quantified.

This mode of operation exhibits a double selectivity, with regard to the selection of the precursor ion on the one hand, and the selection of the first-generation fragment ion on the other hand. Mass spectrometry in SRM or MRM mode is therefore advantageous for quantification.

When the mass spectrometry employed in the method according to invention is tandem mass spectrometry (MS$^2$, MS$^3$, MS$^4$ or MS$^5$), several mass analysers can be linked to one another. For example, a first analyser separates the ions, a collision cell makes it possible to fragment the ions, and a second analyser separates the fragment ions. Certain analysers, such as the ion traps or the FT-ICR, constitute several analysers in one and make it possible to fragment the ions and analyse the fragments directly.

According to preferred embodiments of the invention, the method of the invention comprises one or more of the following characteristics:

the mass spectrometry employed for the properties of potential resistance to at least one antimicrobial is MS/MS spectrometry, which has the advantage of producing a fragment which is specific to the molecule to be detected or quantified, and thus of providing great specificity to the assaying method;

the MS/MS spectrometry is MRM which has the advantage of using an analysis cycle time in the mass spectrometer of several tens of milliseconds, which makes it possible to detect or quantify, with a high degree of sensitivity, a large number of different molecules in a multiplexed manner;

where applicable, the determination of the type properties and of the virulence factor is performed in the same mass spectrometry apparatus as the determination of the markers of resistance to at least one antimicrobial, preferably simultaneously, which has the advantage of reducing the analysis time and the cost of the instrument, which also facilitates the processing and the yielding of the results.

In addition to determining the resistance to an antibiotic, it is necessary to identify the microorganism or microorganisms present in the sample to be tested.

The methods of identifying microorganisms are widely known to the person skilled in the art, as described for example by Murray P. R. et al. in Manual of Clinical Microbiology, 2007, 9$^{th}$ edition, and especially in Vol. I, Section III, chapters 15 and 16 for bacteria and yeasts, Vol. II, Section VI, chapter 82 for viruses, and Vol. II, Section X, chapter 135 for protozoa. As an example of conventional identification methods, mention can be made of the determination of the biological profile, by using the Vitek 2 (bioMérieux) identification cards, for example, or even by using molecular biology techniques with identification criteria based on the study of the presence of certain genes, and on the study of their sequence.

Identification can be performed directly from the sample in which the identification is made, or the microorganisms contained in the sample can be cultured using methods well known to the person skilled in the art with optimal culture media and culturing conditions tailored to the species of microorganisms to be sought, as described by Murray P. R. et al. in Manual of Clinical Microbiology, 2007, 9$^{th}$ edition, Vol. I, Section III, chapter 14, and in particular in Vol. I, Section IV, chapter 21 for bacteria, and Vol. II, Section VI, chapter 81 for viruses, Vol. II, Section VIII, chapter 117 for yeasts, and Vol. II, Section X, chapter 134 for protozoa.

Thus, generally, in the case of an identification using a biochemical method of a bacterium in a specimen, it is first necessary to obtain it in a pure culture, for example after seeding on agar. Molecular biology (PCR) can in certain cases be applied directly to the sample to be analysed.

Instead of cultivating the microorganisms, they can be concentrated by capture directly in the sample by means of active surfaces. Such a method was described by W.-J. Chen et al. [11] who captured different bacterial species with the aid of magnetic beads with an $Fe_3O_4/TiO_2$-activated surface. Capture by other means is also possible, such as a capture by lectins [23], or by antibodies [24], or by Vancomycin [25]. The capture makes it possible to concentrate the microorganisms and thus to reduce or even eliminate the culture step. This results in a considerable timesaving.

The identification may also be performed by mass spectrometry, in accordance with the techniques described previously, preferably by MS, by MS/MS, or even by MS followed by MS/MS spectrometry, which constitutes one embodiment of the invention. In this case too, the sample can be subjected to a culture step beforehand, such as seeding on agar.

The use of an MS identification method is advantageous in that it may be carried out in a few minutes, and in that it requires a mass spectrometer with a single analyser, i.e. a less complex instrument than a tandem mass spectrometer used in MS/MS.

The use of a method of identification by MS followed by MS/MS spectrometry is also advantageous. It makes it possible to check the identity of the ions observed by MS, which increases the specificity of the analysis.

The use of an MRM-type MS/MS identification method has the advantage of being more sensitive and simpler than the conventional MS followed by MS/MS approaches. This method requires neither a high-performance software to process the information between the acquisition of the MS spectrum and of the MS/MS spectrum, nor a change in the setting of the machine parameters for linking up MS then MS/MS spectra.

The method of identification by MS may be employed with an electrospray source on a raw sample, as described by S. Vaidyanathan et al. [26] or by R. Everley et al. [27] after chromatographic separation. Different m/z ranges thus make it possible to identify the microorganisms. S. Vaidyanathan et al. used a window of between 200 and 2000 Th, and R. Everley et al. used a window of between 620 and 2450 Th. The mass spectra may also be deconvoluted to access the mass of the proteins independently of their charge state. R. Everley et al. therefore used masses of between about 5,000 and 50,000 Da. Alternatively, the method of identification by MS can also be employed with the aid of a MALDI-TOF, as described by Claydon et al. [3] and T. Krishnamurthy and P. Ross [4]. The analysis combines acquisition of a mass spectrum and interpretation of expert software. It is extremely simple and can be carried out in a few minutes. This method of identification is currently becoming more widespread in medical analysis laboratories [28].

The identification of bacteria by MS followed by MS/MS via their proteins present in the sample has been applied widely by a number of teams. By way of example, mention can be made of the recent work of Manes N. et al. [29], who studied the peptidome of *Salmonella enterica*, or the work of R. Nandakumar et al. [30] or of L. Hernychova et al. [31] who have studied the proteome of bacteria after digestion of the proteins with trypsin. The conventional approach consists in i) acquiring an MS spectrum, ii) successively selecting each precursor ion observed on the MS spectrum with an intense signal, iii) successively fragmenting each precursor ion and acquiring its MS/MS spectrum, iv) interrogating protein databases such as SWISS-PROT or NCBI, through software such as Mascot (Matrix Science, London, United Kingdom) or SEQUEST (Thermo Scientific, Waltham, United States of America), to identify the peptide which has a strong probability of matching the MS/MS spectrum observed. This method may lead to the identification of a microorganism if a protein or a peptide characteristic of the species is identified.

One of the advantages of the use of the mass spectrometry lies in that it is particularly useful for quantifying molecules, in the present case the markers of the mechanisms of bacterial resistance to beta-lactams. To this end, the current intensity detected is used, which is proportional to the quantity of target molecule. The current intensity thus measured may serve as a quantitative measurement making it possible to determine the quantity of target molecule present, which is characterised by its expression in International System (SI) mol/m$^3$ or kg/m$^3$ units, or by multiples or sub-multiples of these units, or by the usual derivatives of the SI units, including multiples or sub-multiples thereof. As a non-limiting example, the units such as ng/ml or fmol/l are units characterising a quantitative measurement.

A calibration is nevertheless necessary in order to be able to correlate the measured area of the peak, which corresponds to the current intensity induced by the detected ions, to the quantity of target molecule to be assayed. For this purpose, the calibrations conventionally used in mass spectrometry may be employed, within the framework of the invention. MRM assays are conventionally calibrated with the aid of external standards or, preferably, with the aid of internal standards such as described by T. Fortin et al. [13]. If the target molecule is a proteotypic peptide which permits the assaying of a protein of interest, the correlation between the quantitative measurement and the quantity of target proteotypic peptide, and subsequently of protein of interest, is obtained by calibrating the measured signal relative to a standard signal for which the quantity to be assayed is known. The calibration may be performed using a calibration curve, for example obtained by successive injections of standard proteotypic peptide at different concentrations (external calibration), or preferably by internal calibration using a heavy peptide as an internal standard, for example in accordance with the AQUA, QconCAT or PSAQ methods detailed below. "Heavy peptide" is understood to mean a peptide corresponding to the proteotypic peptide, but in which one or more atoms of carbon 12 ($^{12}$C) is (are) replaced by carbon 13 ($^{13}$C), and/or one or more atoms of nitrogen 14 ($^{14}$N) is (are) replaced by nitrogen 15 ($^{15}$N).

The use of heavy peptides as internal standards (AQUA) was also proposed in US patent application 2004/0229283. The principle is to artificially synthesise proteotypic peptides with amino acids containing isotopes which are heavier than the usual natural isotopes. Such amino acids are obtained, for example, by replacing some of the atoms of carbon 12 ($^{12}$C) with carbon 13 ($^{13}$C), or by replacing some of the atoms of nitrogen 14 ($^{14}$N) with nitrogen 15 ($^{15}$N). The artificial peptide (AQUA) thus synthesised has strictly the same physicochemical properties as the natural peptide (with the exception of a higher mass). It is generally added, at a given concentration, to the sample, upstream of assaying by mass spectroscopy, for example between the treatment entailing the cleaving of the proteins in the sample of interest and the fractionation of the peptides obtained after the treatment step. Thus, the AQUA peptide is co-purified with the natural peptide to be assayed, during fractionation of the peptides. The two peptides are therefore injected simultaneously into the mass spectrometer, for assaying. They then undergo the same ionisation yield in the source. The comparison of the peak areas of the natural and AQUA peptides, whose concentration is known, makes it possible to calculate the concentration of the natural peptide and thus trace back the concentration of the protein to be assayed. A variation of the AQUA technique was proposed by J.-M. Pratt et al. [32] under the name QconCat. This variant is also described in patent application WO 2006/128492. It consists in concatenating various AQUA peptides and producing the artificial polypeptide in the form of a heavy recombinant protein. The recombinant protein is synthesised with amino acids comprising heavy isotopes. In this way, it is possible to obtain a standard to calibrate the simultaneous assay of several proteins at lower cost. The QconCAT standard is added from the start, upstream of the treatment entailing the cleaving of the proteins and prior to the steps of protein fractionation, denaturation, reduction and blocking of the protein thiol functions, if these are present. The QconCAT standard therefore undergoes the same treatment cycle entailing the cleaving of the proteins as the natural protein, which makes it possible to take account of the yield from the treatment step which entails the cleaving of the proteins. In fact, the treatment, particularly by digestion, of the natural protein may not be complete. In this case, the use of an AQUA standard would lead to underestimating the quantity of natural protein. For full assaying, it may therefore be important to take into account the yields from treatment which entails the cleaving of the proteins. However, V. Brun et al. [33] have shown that the QconQAT standards sometimes do not exactly reproduce the treatment yield, particularly by digestion of the natural protein, undoubtedly due to a three-dimensional conformation different from the QconCAT protein.

V. Brun et al. [33] then proposed the use of a method dubbed PSAQ, and described in patent application WO 2008/145763. In this case, the internal standard is a recombinant protein having the same sequence as the natural protein but synthesised with heavy amino acids. The synthesis is performed ex-vivo with heavy amino acids. This standard has strictly the same physicochemical properties as the natural protein (with the exception of a higher mass). It is added from the start, before the protein fractionation step, when the latter is present. It is therefore co-purified with the native protein, during the protein fractionation step. It exhibits the same treatment yield, particularly by digestion, as the native protein. The heavy peptide obtained after cleaving is also co-purified with the natural peptide, if a peptide fractionation step is performed. The two peptides are therefore injected simultaneously into the mass spectrometer, to be quantitatively assayed. They then undergo the same ionisation yield in the source. Comparison of the peak areas of the natural and the reference peptides in the PSAQ method make it possible to calculate the concentration of the protein to be assayed taking into account all of the steps of the assay method.

All of these techniques, namely AQUA, QconCAT or PSAQ or any other calibration technique, used in the mass spectrometry assays and in particular in MRM or MS assays, may be employed to carry out calibration, within the framework of the invention.

Preferably, the mass spectrometry used in the detection method according to the invention is MS/MS. More preferably, the mass spectrometry is MRM.

The method of the invention makes it possible to detect resistances to cephalosporin, characterised by the detection of at least one peptide as a resistance marker. Said resistance marker peptide preferably belongs to the proteins TEM, CMY, CTX-M, SHV, FOX, ACC, ACT, CARB, DHA, MIR, MOX, PER, VEB, OXA or GES.

In particular, the detection of a mechanism of resistance to cephalosporins induced by the expression of the TEM protein is characterised by the detection of at least one peptide belonging to the TEM protein and its different sequence variants SEQ ID No. 1 to SEQ ID No. 165 and SEQ ID No. 1836 to SEQ ID No. 1843.

SEQ ID No. 1:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 2:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 3:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

-continued
```
MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 4:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYMTGSQATMDERNRQIAEIGASLIKHW

SEQ ID No. 5:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSRGIIAALGPDGKPSRIVVIYTTGSQATMDERNRQIAEIGASLIKHW

SEQ ID No. 6:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 7:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 8:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 9:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 10:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI
```

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 11:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 12:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 13:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 14:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 15:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 16:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 17:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

-continued

SEQ ID No. 18:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 19:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 20:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLRNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 21:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGGSERGSRGIIAALGPDGKPSRIVVIYTTGSQATMDERNRQIAEIGASLIKH

SEQ ID No. 22:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSRGIIAALGPDGKPSRIVVIYTTGSQATMDERNRQIAEIGASLIKHW

SEQ ID No. 23:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYMTGSQATMDERNRQIAEIGASLIKHW

SEQ ID No. 24:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 25:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

-continued

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYMTGSQATMDERNRQIAEIGASLIKHW

SEQ ID No. 26:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 27:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 28:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

HADKSGAGERGSSGIIAALGPDGKPSRIVVIYTTGSQATMDERNRQIAEIGASLIKHW

SEQ ID No. 29:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSCGIIAALGPDGKPSRIVVIYTTGSQATMDERNRQIAEIGASLIKHW

SEQ ID No. 30:
MSIQHFRVALIPFFAAFCLPVFAHPETLVKVKDAEDQLGARVGYIELDLNSGKILESF

RPEERFPMISTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 31:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 32:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 33:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 34:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 35:
MSIQHFRVALIPFFAAFCLPVFAHPETLVKVKDAEDQLGARVGYIELDLNSGKILESF

RPEERFPMISTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 36:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDELNRQIAEIGASLIKHW

SEQ ID No. 37:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRREPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDERDRQIAEIGASLIKHW

SEQ ID No. 38:
MSIQHFRVALIPFFAAFCLPVFAHPETLVKVKDAEDQLGARVGYIELDLNSGKILESF

RPEERFPMISTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 39:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSTGIIAALGPDGKPSRIVVIYTTGSQATMDERNRQIAEIGASLIKHW

SEQ ID No. 40:
MSIQHFRVALIPFFAAFCLPVFAHPETLVKVKDAEDKLGVRVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDERNRQIAEIGASLIKHW

SEQ ID No. 41:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 42:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSSGIIAALGPDGKPSRIVVIYTTGSQATMDERNRQIAEIGASLIKHW

SEQ ID No. 43:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDEQNRQIAEIGASLIKHW

SEQ ID No. 44:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 45:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDERNRQIAEIGASLIKHW

SEQ ID No. 46:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDERNRQIAEIGASLIKHW

SEQ ID No. 47:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGGQATMDERNRQIAEIGASLIKHW

SEQ ID No. 48:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERDRQIAEIGASLIKHW

SEQ ID No. 49:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSHGIIAALGPDGKPSRIVVIYTTGSQATMDERNRQIAEIGASLIKHW

SEQ ID No. 50:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 51:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 52:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSLGIIAALGPDGKPSRIVVIYTTGSQATMDERNRQIAEIGASLIKHW

SEQ ID No. 53:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAEPLLRSALPAGW

FIADKSGAGERGSRGIIAALGPDGKPSRIVVIYTTGSQATMDERNRQIAEIGASLIKHW

SEQ ID No. 54:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLRNMGDHVTRLDRWEPELNEAI

-continued

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 55:
MSIQHFRVALIPFFAAFCLPVFAHPETLVKVKDAEDQLGARVGYIELDLNSGKILESF

RPEERFPMMSTFKVLLCGAVLSRVDAGQEQLDRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 56:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSSGIIAALGPDGKPSRIVIIYTTGSQATMDERNRQIAEIGASLIKHW

SEQ ID No. 57:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMGDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 58:
MSIQHFRVALIPFFAAFCLPVFAHPETLVKVKDAEDKLGARVGYIELDPNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 59:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 60:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 61:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSCGIIAALGPDGKPSRIVVIYTTGSQATMDERNRQIAEIGASLIKHW

SEQ ID No. 62:
MSIQHFRVALIPFFAAFCLPVFAHPETLVKVKDAEDKLGARVGYIELDLNSGKILESFR

PEERFPMMSTFKVLLCGAVLSRVDAGQEQLDRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 63:
MSIQHFRVALIPFFAAFCIPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSCGIIAALGPDGKPSRIVVIYTTGSQATMDERNRQIAEIGASLIKHW

SEQ ID No. 64:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDELNRQIAEIGASLIKHW

SEQ ID No. 65:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASQQQLIDWMEADKVAGPLLRSALPAGW

FIADKSGAGERGSRGIIAALGPDGKPSRIVVIYTTGSQATMDERNRQIAEIGASLIKHW

SEQ ID No. 66:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYTTGSQATMDERNRQIAEIGASLIKHW

SEQ ID No. 67:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASKRGSRGIIAALGPDGKPSRIVVIYTTGSQATMDERNRQIAEIGASLIKHW

SEQ ID No. 68:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSCGIIAALGPDGKPSRIVVIYMTGSQATMDERNRQIAEIGASLIKHW

SEQ ID No. 69:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSSGIIAALGPDGKPSRAIVVIYMTGSQATMDERNRQIAEIGASLIKHW

SEQ ID No. 70:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 71:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMGDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 72:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSSGIIAALGPDGKPSRIVVIYTTGSQATMDERNRQIAEIGASLIKHW

SEQ ID No. 73:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRREPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDERDRQIAEIGASLIKHW

SEQ ID No. 74:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSGGIIAALGPDGKPSRIVVIYTTGSQATMDERNRQIAEIGASLIKHW

SEQ ID No. 75:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAVTMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 76:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAVTMSDNTAANLLLTTIGGPKELTAFLHNMGDHVTRLDRWEPELNEAI

-continued

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 77:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDEQNRQIAEIGASLIKHW

SEQ ID No. 78:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRCEPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDEQNRQIAEIGASLIKHW

SEQ ID No. 79:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 80:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYMTGSQATMDERNRQIAEIGASLIKHW

SEQ ID No. 81:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSRGIIAALGPDGKPSRIVVIYMTGSQATMDERNRQIAEIGASLIKHW

SEQ ID No. 82:
MSIKHFRVALIPFFAAFCLPVFAHPETLVKVKDAEDQLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLHCWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 83:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTDELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 84:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMGDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 85:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTG

GMTVRELCSAAITMSDNTAANLLLTTIGGPKELTAFLHNMGDHVTRLDRWEPELNE

AIPNDERDTTMPAAMATTLRKLLTGELLTLASRQQLIDWMEADKVAGPLLRSALPAG

WFIADKSGAGERGSRGIIAALGPDGKPSRIVVIYTTGSQATMDERNRQIAEIGASLIK

HW

SEQ ID No. 86:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDCWEPELNEAI

PNDERDTTTPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 87:
MSIKHFRVALIPFFAAFCLPVFAHPETLVKVKDAEDQLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 88:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASKRGSRGIIAALGPDGKPSRIVVIYTTGSQATMDERNRQIAEIGASLIKHW

SEQ ID No. 89:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASERGSRGIIAALGPDGKPSRIVVIYMTGSQATMDERNRQIAEIGASLIKHW

SEQ ID No. 90:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGAKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

-continued

SEQ ID No. 91:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLGRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 92:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYTTGSQATMDERNRQIVEIGASLIKHW

SEQ ID No. 93:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 94:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDELNRQIAEIGASLIKHW

SEQ ID No. 95:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIVEIGASLIKHW

SEQ ID No. 96:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCNAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 97:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 98:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTTPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 99:
MSIQHFRVALIPFFAAFCLPVFAHPETLVKVKDAEDQLGARVGYIELDLNSGKILESF

RPEERFPMMSTFKVLLCGAELSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTSELLTLASRQQLIDWMEADKVAGPLLRSALPAGW

FIADKSGAGERGSRGIIAALGPDGKPSRIVVIYTTGSQATMDERSRQIAEIGASLIKHW

SEQ ID No. 100:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 101:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 102:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGADERGSRGIIAALGPDGKPSRIVVIYMTGSQATMDERNRQIAEIGASLIKHW

SEQ ID No. 103:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLRNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 104:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 105:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSRGIIAALGPDGKPSRIVVIYTTGSQATMDERNRQIAEIGASLIKHW

SEQ ID No. 106:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 107:
MSIQHFRVALIPFFAAFCLPVFAHPETLVKVKDAEDQLGARVGYIELDLNSGKILESF

RPEERFPMMSTFKVLLCGAVLSRIDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPVAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 108:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 109:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 110:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 111:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSSGIIAALGPDGKPSRIVVIYTTGSQATMDERNRQIAEIGASLIKHW

SEQ ID No. 112:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDEQNRQIAEIGASLIKHW

SEQ ID No. 113:
MSIKHFRVALIPFFAAFCLPVFAHPETLVKVKDAEDQLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 114:
MSIKHFRVALIPFFAAFCLPVFAHPETLVKVKDAEDQLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 115:
MSIQHFRVALIPFLAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSREPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDERDRQIAEIGASLIKHW

SEQ ID No. 116:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERETTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 117:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDNVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 118:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGEHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 119:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 120:
MSIQHFRVALIPFFAAFCLPVFAHPETLVKVKPAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGERGSRGIIAALGPDGKPSRIVVIYTTGSQATMDERNRQIAEIGASLIKHW

SEQ ID No. 121:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTTPAAMATTLRKLLTGELLTLASRQQLIDWMEADKVAGPLLRSALPAGW

FIADKSGTGERGSRGIIAALGPDGKPSRIVVIYTTGSQATMDERNRQIAEIGASLIKHW

SEQ ID No. 122:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAV

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 123:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 124:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 125:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 126:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGTGKRGSRGIIAALGPDGKPSRIVVIYTTGGQATMDERNRQIAEIGASLIKHW

SEQ ID No. 127:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

SEQ ID No. 128:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PIDERDTTMPAAMATTLRKLLTGELLTLASRQQLIDWMEADKVAGPLLRSALPAGWF

IADKSGASERGSRGIIAALGPDGKPSRIVVIYTTGSQATMDERNRQIAEIGASLIKHW

SEQ ID No. 129:
MSIQHFRVALIPFFAAFCLPVFAHPETLVKVKDAEDKLGARVGYIEMDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASERGSRGIIAALGPDGKPSRIVVIYTTGSQATMDERNRQIAEIGASLIKHW

SEQ ID No. 130:
MSIQHFRVALIPFFAAFCLPVFAHPETLVKVEDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 131:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGANERGSRGIIAALGPDGKPSRIVVIYMTGSQATMDERNRQIAEIGASLIKHW

SEQ ID No. 132:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDCWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 133:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDCWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 134:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLMRSALPAG

-continued
```
WFIADKSGAGERGSHGIIAALGPDGKPSRIVVIYTTGSQATMDERNRQIAEIGASLIK

HW

SEQ ID No. 135:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLPD

GMTVRELCSAAITMSDNTAANLLLTTIGGPKELTAFLHNMGDHVTRLDRWEPELNE

AIPNDERDTTMPAAMATTLRKLLTGELLTLASRQQLIDWMEADKVAGPLLRSALPAG

WFIADKSGAGERGSHGIIAALGPDGKPSRIVVIYTTGSQATMDERNRQIAEIGASLIK

HW

SEQ ID No. 136:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSVLPAGW

FIADKSGAGERGSRGIIAALGPDGKPSRIVVIYTTGSQATMDERNRQIAEIGASLIKHW

SEQ ID No. 137:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATKLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 138:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTTPAAMATTLRKLLTGELLTLASRQQLIDWMEADKVAGPLLRSALPAGW

FIADKSGAGVRGSRGIIAALGPDGKPSRIVVIYTTGSQATMDERNRQIAEIGASLIKHW

SEQ ID No. 139:
MSIQHFRVALIPFFAAFCLPVFAHPDTLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 140:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGGSLIKHW

SEQ ID No. 141:
MSIQHFRVALIPFFAAFCLPVFAHPETLVKVKDAEDQLGARVGYIELDLNSGKILESF

RPEERFPMVSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI
```

-continued

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERDRQIAEIGASLIKHW

SEQ ID No. 142:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 143:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGKRGSRGIIAALGPDGKPSRIVVIYTTGSQATMDERNRQIAEIGASLIKHW

SEQ ID No. 144:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNIGDHVTRLDRWEPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDERNRQIAEIGASLIKHW

SEQ ID No. 145:
MSIQHFRVALIPFFAAFCLPVFAHPETLVKVKDAEDQLGARVGYIELDLNSGKILESF

RPEERFPMMSTFKVLLCGAVLSRIDAGQEQLGRRIHYSQSDLVEYSPVTEKHLTDG

MTVRELCSAAITMSDNTAANLLLTTIGGPKELTAFLHNMGDHVTRLDRWEPELNEAI

PNDERDTTMPVAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 146:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERDRQIAEIGASLIKHW

SEQ ID No. 147:
MSIQHFRVALIPFFAAFCFPVFAHPETLVKVKDAEDQLGARVGYIELDLNSGKILESF

RPEERFPMISTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 148:
MSIQHFRVALIPFFAAFCLPVFAHPETLVKVKDAEDKLGARVGYIELDLNSGKILESFR

PEERFPMVSTFKVLLCGAVLSRVDAGQEQLGRRIHYSQNDLVEYSPVTEKHLTDGM

TVRELCSAAITMSDNTAANLLLTTIGGPKELTAFLHNMGDHVTRLDRWEPELNEAIP

NDERDTTMPAAMATTLRKLLTGELLTLASRQQLIDWMEADKVAGPLLRSALPAGWF

IADKSGAGERGSRGIIAALGPDGKPSRIVVIYTTGSQATMDERNRQIAEIGASLIKHW

SEQ ID No. 149:
MSIKHFRVALIPFFAAFCLPVFAHPETLVKVKDAEDQLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDHWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 150:
MSIQHFRVALIPFFAAFCLPVFAHPKTLVKVKDAENQLGARVGYIELDLNSGKILESF

RPEKRFPMMSTFKVLLCGAVLSRIDAGQEQLGRRIHYSQSDVVEYSPVTEKHLTDG

MTVRELCSAAITMSDNTAANLLLTTIGGPKELTAFLHNMGDHVTRLDRWEPELNEAI

PNDERDTTMPVAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 151:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDEQNRQIAEIGASLIKLW

SEQ ID No. 152:
MSIQHFRVALIPFFAAFCLPVFAHPETLVKVKDAEDQVGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQTAEIGASLIKHW

SEQ ID No. 153:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDSWEPELNEAI

PNDERDTTTPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 154:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVGELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 155:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSVLPAGW

FIADKSGASERGSRGIIAALGPDGKPSRIVVIYMTGSQATMDERNRQIAEIGASLIKHW

SEQ ID No. 156:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYMTGSQATMDERNRQIAEIGASLIKHW

SEQ ID No. 157:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRGEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 158:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEICASLIKHW

SEQ ID No. 159:
MSIQHFRVALIPFFAAFCLPVFAHPETLVKVKDAEDQLGARVGYIELDLNSGKILESF

RPEERFPMMSTFKVLLCGAVLSRIDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 160:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEVDKVAGPLLRSALPAGW

FIADKSGAGERGSSGIIAALGPDGKPSRIVIIYTTGSQATMDERNRQIAEIGASLIKHW

SEQ ID No. 161:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEVDKVAGPLLRSALPAGW

FIADKSGAGERGSSGIIAALGPDGKPSRIVVIYTTGSQATMDERKRQIAEIGASLIKHW

SEQ ID No. 162:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEVDKVAGPLLRSALPAGW

FIADKSGAGERGSRGIIAALGPDGKPSRIVVIYTTGSQATMDERNRQIAEIGASLIKHW

SEQ ID No. 163:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

-continued

PNDERDTTMPAAMATTLRKLLTGELLTLASRQQLIDWMEADKVAGPLLRSVLPAGW

FIADKSGAGERGSRGIIAALGPDGKPSRIVVIYTTGSQATMDERNRQIAEIGASLIKHW

SEQ ID No. 164:
MSIKHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVKYSPVTEKHLTDG

MTVRELCSAAITMSDNTAANLLLTTIGGPKELTAFLHNMGDHVTRLDSWEPELNEAI

PNDERDTTTPAAMATTLRKLLTGELLTLASRQQLIDWMEADKVAGPLLRSALPAGW

FIADKSGTGKRGSRGIIAALGPDGKPSRIVVIYTTGSQATMDERNRQIAEIGASLIKHW

SEQ ID No. 165:
MSIQHFRVALIPFFAAFCLPVFAHPETLVKVKDAEDQLGSTSGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGSQELTAFLHNMGDHVTRLDRWEPELNEAI

PNDEADTTMPAAMATTLRKLLTGELLTLASRQQLIDWMADKVAGPLLRSALPAGWFI

ADKSGARERGSRGIIAALGPDGKPSRIVVIYTTGSQATMDERNRQIAEIGASLIKHW

SEQ ID No. 1836:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 1837:
MSIQHFRVALIPFFAAFCLPVFAHPETLVKVKDAEDQLGARVGYIELDLNSGKILESF

RPEERFPMLSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 1838:
MSIQHFRVALIPFFAAFCLPVFAHPETLVKVKDAEDKLGARVGYIELDLNSGKILESFR

PEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 1839:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDERNRQIAEIGASLIKHW

SEQ ID No. 1840:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGSQATMDERNRQIAEIGASLIKHW

-continued

SEQ ID No. 1841:
MSIQHFRVALIPFFAAFCFPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGASKRGSRGIIAALGPDGKPSRIVVIYMTGGQATMDERNRQIAEIGASLIKHW

SEQ ID No. 1842:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDHWEPELNEAI

PNDERDTTMPAAMATTLRKLLTGELLTLASRQQLIDWMEADKVAGPLLRSALPAGW

FIADKSGAGERGSRGIIAALGPDGKPSRIVVIYTTGSQATMDERNRQIAEIGASLIKHW

SEQ ID No. 1843:
MSIQHFRVALIPFFAAFCLPVFAHPETLVKVKDAEDQLGARVGYIELDLNSGKILESF

RPEERFPMMSTFKVLLCGAVLSRVDAGQEQLGRRIHYSQNDLVEYSPVTEKHLTDG

MTVRELCSAAITMSDNTAANLLLTTIGGPKELTAFLHNMGDHVTRLDRWEPELNEAI

PNDERDTTMPAAMATTLRKLLTGELLTLASRQQLIDWMEADKVAGPLLRSALPAGW

FIADKSGAGERGSSGIIAALGPDGKPSRIVVIYTTGSQATMDERNRQIAEIGASLIKHW said peptides being chosen, preferably, from the peptides of sequence SEQ ID No. 166 to SEQ ID 261 and SEQ ID No. 1923 to SEQ ID 1928 as defined hereafter:

| Peptide SEQ ID No. | Amino acid sequence | Position of the peptide in the TEM protein(s) | Clinical interest |
|---|---|---|---|
| SEQ ID No. 166 | CEPELNEAIPNDER | 163-176 for the protein of SEQ No. 78 | 2br |
| SEQ ID No. 167 | DAEDQLGAR | 33-41 for the proteins of SEQ No. 1, 4, 5, 6, 9, 10, 12, 14, 16, 18, 19, 23, 24, 25, 26, 27, 28, 29, 30, 31, 32, 33, 34, 35, 36, 37, 38, 39, 41, 43, 45, 46, 47, 48, 49, 50, 51, 52, 53, 55, 56, 60, 64, 65, 66, 68, 69, 70, 71, 72, 73, 74, 75, 76, 77, 78, 79, 80, 81, 82, 83, 85, 86, 87, 88, 89, 90, 91, 93, 94, 95, 96, 97, 98, 99, 100, 101, 102, 103, 106, 107, 108, 109, 110, 112, 113, 114, 115, 116, 117, 118, 121, 122, 123, 125, 126, 127, 128, 130, 131, 132, 133, 134, 135, 136, 137, 138, 139, 140, 141, 142, 144, 145, 146, 147, 149, 151, 153, 154, 155, 156, 157, 158, 159, 160, 161, 162, 163, 1837, 1838, 1840, 1841, 1842, 1843, 1844 | TEM |
| SEQ ID No. 168 | DAEDQLGSTSGYIELDLNSGK | 33-53 for the protein of SEQ No. 165 | 2be |
| SEQ ID No. 169 | DAEDQVGAR | 33-41 for the protein of SEQ No. 152 | 2be |
| SEQ ID No. 170 | DAENQLGAR | 33-41 for the protein of SEQ No. 150 | TEM |
| SEQ ID No. 171 | DTTMPAAMATK | 177-187 for the protein of SEQ No. 137 | TEM |
| SEQ ID No. 172 | DTTMPAAMATTLR | 177-189 for the proteins of SEQ No. 1, 2, 3, 4, 5, 6, 7, 8, 9, 10, 11, 12, 13, 14, 15, 16, 17, 18, 20, 21, 22, 23, 24, 25, 26, 27, 28, 29, 31, 32, 33, 34, 35, 36, 37, 38, 39, 40, 42, 43, 44, 45, 46, 47, 48, 49, 51, 52, | TEM |

-continued

| Peptide SEQ ID No. | Amino acid sequence | Position of the peptide in the TEM protein(s) | Clinical interest |
|---|---|---|---|
| | | 53, 54, 55, 56, 57, 58, 59, 61, 62, 63, 64, 65, 66, 68, 69, 70, 71, 72, 73, 74, 75, 76, 77, 78, 79, 80, 81, 84, 85, 90, 91, 92, 93, 94, 95, 96, 99, 100, 101, 102, 103, 105, 106, 108, 109, 110, 111, 112, 113, 115, 117, 118, 119, 120, 122, 123, 124, 126, 127, 128, 129, 130, 131, 132, 133, 134, 135, 136, 139, 140, 141, 142, 143, 144, 146, 148, 151, 152, 154, 155, 156, 157, 158, 159, 160, 161, 162, 163, 165, 1837, 1838, 1839, 1840, 1841, 1842, 1843, 1844 | |
| SEQ ID No. 173 | DTTMPVAMATTLR | 177-189 for the proteins of SEQ No. 107, 145, 150 | TEM |
| SEQ ID No. 174 | DTTTPAAMATTLR | 177-189 for the proteins of SEQ No. 19, 30, 41, 50, 60, 67, 82, 83, 86, 87, 88, 89, 97, 98, 104, 114, 121, 125, 138, 147, 149, 153, 164 | TEM |
| SEQ ID No. 175 | ELTAFLHNIGDHVTR | 145-159 for the protein of SEQ No. 144 | TEM |
| SEQ ID No. 176 | ELTAFLHNMGDHVTR | 145-159 for the proteins of SEQ No. 1, 2, 3, 4, 5, 6, 7, 8, 9, 10, 11, 12, 13, 14, 15, 16, 17, 18, 19, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 104, 105, 106, 107, 108, 109, 110, 111, 112, 113, 114, 115, 116, 119, 120, 121, 122, 123, 124, 125, 126, 127, 128, 129, 130, 131, 132, 133, 134, 135, 136, 137, 138, 139, 140, 141, 142, 143, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | TEM |
| SEQ ID No. 177 | ELTAFLHNMGDNVTR | 145-159 for the protein of SEQ No. 117 | 2b |
| SEQ ID No. 178 | ELTAFLHNMGEHVTR | 145-159 for the protein of SEQ No. 118 | 2b |
| SEQ ID No. 179 | ELTAFLR | 145-151 for the proteins of SEQ No. 20, 54, 103 | 2be |
| SEQ ID No. 180 | EPELNEAIPNDER | 164-176 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 123, 124, 125, 126, 127, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 1837, 1838, 1839, 1840, 1841, 1842, 1843, 1844 | TEM |
| SEQ ID No. 181 | ETTTPAAMATTLR | 177-189 for the protein of SEQ No. 116 | 2be |

-continued

| Peptide SEQ ID No. | Amino acid sequence | Position of the peptide in the TEM protein(s) | Clinical interest |
|---|---|---|---|
| SEQ ID No. 182 | FPMISTFK | 64-71 for the proteins of SEQ No. 30, 35, 38, 147 | 2br |
| SEQ ID No. 183 | FPMLSTFK | 64-71 for the proteins of SEQ No. 31, 33, 37, 43, 48, 72, 76, 78, 100, 115, 142, 146, 157, 1838 | TEM |
| SEQ ID No. 184 | FPMMSTFK | 64-71 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 39, 40, 41, 42, 44, 45, 46, 47, 49, 50, 51, 52, 53, 54, 55, 56, 57, 58, 59, 60, 61, 62, 63, 64, 65, 66, 67, 68, 69, 70, 71, 74, 79, 80, 81, 82, 83, 84, 85, 86, 87, 88, 89, 90, 91, 92, 93, 94, 95, 96, 97, 98, 99, 101, 102, 103, 104, 105, 106, 107, 108, 109, 110, 111, 112, 113, 114, 116, 117, 118, 119, 120, 121, 122, 123, 124, 125, 126, 127, 128, 129, 130, 131, 132, 133, 134, 135, 136, 137, 138, 139, 143, 144, 145, 149, 150, 151, 152, 153, 154, 155, 156, 158, 159, 160, 161, 162, 163, 164, 165, 1837, 1839, 1840, 1841, 1842, 1843, 1844 | TEM |
| SEQ ID No. 185 | FPMVSTFK | 64-71 for the proteins of SEQ No. 32, 34, 36, 73, 77, 140, 141, 148 | TEM |
| SEQ ID No. 186 | GEPELNEAIPNDER | 163-176 for the protein of SEQ No. 157 | 2be |
| SEQ ID No. 187 | GIIAALGPDGKPSR | 242-255 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 1837, 1838, 1839, 1840, 1841, 1842, 1843, 1844; 241-254 for the protein of sequence SEQ ID No. 165 | TEM |
| SEQ ID No. 188 | GSCGIIAALGPDGKPSR | 239-255 for the proteins of SEQ No. 29, 61, 63, 68 | 2br |
| SEQ ID No. 189 | GSGGIIAALGPDGKPSR | 239-255 for the protein of SEQ No. 74 | 2br |
| SEQ ID No. 190 | GSHGIIAALGPDGKPSR | 239-255 for the proteins of SEQ No. 49, 134, 135 | 2br |
| SEQ ID No. 191 | GSLGIIAALGPDGKPSR | 239-255 for the protein of SEQ No. 52 | 2br |
| SEQ ID No. 192 | GSSGIIAALGPDGKPSR | 239-255 for the proteins of SEQ No. 28, 42, 56, 69, 72, 111, 160, 161, 1844 | TEM |
| SEQ ID No. 193 | GSTGIIAALGPDGKPSR | 239-255 for the protein of SEQ No. 39 | TEM |
| SEQ ID No. 194 | HLPDGMTVR | 110-118 for the protein of SEQ No. 135 | TEM |

-continued

| Peptide SEQ ID No. | Amino acid sequence | Position of the peptide in the TEM protein(s) | Clinical interest |
|---|---|---|---|
| SEQ ID No. 195 | HLTDGMTVR | 110-118 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 136, 137, 138, 139, 140, 141, 142, 143, 144, 145, 146, 147, 148, 149, 150, 151, 152, 153, 155, 156, 157, 158, 159, 160, 161, 162, 163, 164, 165, 1837, 1838, 1839, 1840, 1841, 1842, 1843, 1844 | TEM |
| SEQ ID No. 196 | HLTGGMTVR | 110-118 for the protein of SEQ No. 85 | 2b |
| SEQ ID No. 197 | IDAGQEQLGR | 82-91 for the proteins of SEQ No. 107, 145, 150, 159 | TEM |
| SEQ ID No. 198 | IHYSQNDLVEYSPVTEK | 93-109 for the proteins of SEQ No. 1, 2, 5, 7, 10, 11, 12, 13, 18, 19, 23, 25, 26, 27, 28, 29, 30, 31, 32, 33, 34, 35, 36, 37, 38, 39, 40, 42, 43, 45, 46, 47, 49, 51, 52, 53, 55, 56, 57, 59, 61, 63, 64, 65, 66, 67, 68, 69, 70, 71, 72, 73, 74, 75, 76, 77, 78, 79, 80, 81, 85, 86, 88, 90, 91, 92, 93, 94, 95, 96, 99, 101, 103, 105, 106, 107, 108, 109, 110, 112, 115, 116, 117, 118, 122, 125, 126, 127, 130, 132, 133, 134, 135, 136, 137, 139, 140, 141, 142, 143, 144, 146, 147, 148, 151, 152, 153, 154, 156, 157, 158, 159, 160, 161, 162, 163, 165, 1837, 1838, 1839, 1840, 1841, 1842, 1843, 1844 | TEM |
| SEQ ID No. 199 | IHYSQNDLVK | 93-102 for the proteins of SEQ No. 3, 4, 6, 8, 9, 14, 15, 16, 17, 20, 21, 22, 24, 41, 44, 48, 50, 54, 58, 60, 62, 82, 83, 84, 87, 89, 97, 98, 100, 102, 104, 111, 113, 114, 119, 120, 121, 123, 124, 128, 129, 131, 138, 149, 155, 164 | 2be |
| SEQ ID No. 200 | IHYSQSDLVEYSPVTEK | 93-109 for the protein of SEQ No. 145 | 2be |
| SEQ ID No. 201 | IHYSQSDVVEYSPVTEK | 93-109 for the protein of SEQ No. 150 | TEM |
| SEQ ID No. 202 | ILESFRPEER | 54-63 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 151, 152, 153, 154, 155, 156, 157, 158, 159, 160, 161, 162, 163, 164, 165, 1837, 1838, 1839, 1840, 1841, 1842, 1843, 1844 | TEM |

-continued

| Peptide SEQ ID No. | Amino acid sequence | Position of the peptide in the TEM protein(s) | Clinical interest |
|---|---|---|---|
| SEQ ID No. 203 | ILESFRPEK | 54-62 for the protein of SEQ No. 150 | TEM |
| SEQ ID No. 204 | IVIIYTTGSQATMDER | 256-271 for the proteins of SEQ No. 56, 160 | 2br |
| SEQ ID No. 205 | IVVIYMTGGQATMDER | 256-271 for the proteins of SEQ No. 47, 1842 | 2be |
| SEQ ID No. 206 | IVVIYMTGSQATMDELNR | 256-273 for the protein of SEQ No. 64 | 2be |
| SEQ ID No. 207 | IVVIYMTGSQATMDER | 256-271 for the proteins of SEQ No. 4, 9, 13, 23, 25, 40, 45, 46, 68, 69, 70, 80, 81, 89, 93, 101, 102, 109, 131, 155, 156, 1840, 1841 | TEM |
| SEQ ID No. 208 | IVVIYTTGGQATMDER | 256-271 for the protein of SEQ No. 126 | 2be |
| SEQ ID No. 209 | IVVIYTTGSQATMDELNR | 256-273 for the proteins of SEQ No. 36, 94 | 2br |
| SEQ ID No. 210 | IVVIYTTGSQATMDEQNR | 256-273 for the proteins of SEQ No. 43, 77, 78, 112, 151 | 2br |
| SEQ ID No. 211 | IVVIYTTGSQATMDER | 256-271 for the proteins of SEQ No. 1, 2, 3, 5, 6, 7, 8, 10, 11, 12, 14, 15, 16, 17, 18, 19, 20, 21, 22, 24, 26, 27, 28, 29, 30, 31, 32, 33, 34, 35, 37, 38, 39, 41, 42, 44, 48, 49, 50, 51, 52, 53, 54, 55, 57, 58, 59, 60, 61, 62, 63, 65, 66, 67, 71, 72, 73, 74, 75, 76, 79, 82, 83, 84, 85, 86, 87, 88, 90, 91, 92, 95, 96, 97, 98, 99, 100, 103, 104, 105, 106, 107, 108, 110, 111, 113, 114, 115, 116, 117, 118, 119, 120, 121, 122, 123, 124, 125, 127, 128, 129, 130, 132, 133, 134, 135, 136, 137, 138, 139, 140, 141, 142, 143, 144, 145, 146, 147, 148, 149, 150, 152, 153, 154, 157, 158, 159, 161, 162, 163, 164, 1837, 1838, 1839, 1843, 1844 | TEM |
| SEQ ID No. 212 | LDCWEPELNEAIPNDER | 160-176 for the proteins of SEQ No. 86, 132, 133 | 2be |
| SEQ ID No. 213 | LDHWEPELNEAIPNDER | 160-176 for the proteins of SEQ No. 6, 11, 15, 25, 26, 27, 41, 59, 70, 98, 100, 106, 109, 124, 136, 140, 141, 149, 1843 | 2be |
| SEQ ID No. 214 | LDHWEPELNEAVPNDER | 160-176 for the protein of SEQ No. 122 | 2be |
| SEQ ID No. 215 | LDSWEPELNEAIPNDER | 160-176 for the proteins of SEQ No. 5, 7, 8, 9, 10, 12, 22, 24, 44, 51, 58, 60, 80, 81, 93, 105, 111, 119, 120, 121, 123, 126, 127, 138, 142, 143, 146, 153, 164 | 2be |
| SEQ ID No. 216 | LHCWEPELNEAIPNDER | 160-176 for the protein of SEQ No. 82 | 2be |
| SEQ ID No. 217 | LLTDELLTLASR | 191-202 for the protein of SEQ No. 83 | 2be |
| SEQ ID No. 218 | LLTGELLTLASQQQLIDWMEADK | 191-213 for the protein of SEQ No. 65 | TEM |
| SEQ ID No. 219 | LLTGELLTLASR | 191-202 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 66, 67, 68, 69, 70, 71, 72, 73, 74, 75, 76, 77, 78, 79, 80, 81, 82, | TEM |

-continued

| Peptide SEQ ID No. | Amino acid sequence | Position of the peptide in the TEM protein(s) | Clinical interest |
|---|---|---|---|
| | | 84, 85, 86, 87, 88, 89, 90, 91, 92, 93, 94, 95, 96, 97, 98, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | |
| SEQ ID No. 220 | LLTSELLTLASR | 191-202 for the protein of SEQ No. 99 | TEM |
| SEQ ID No. 221 | MSIQHFR | 1-7 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 83, 84, 85, 86, 88, 89, 90, 91, 92, 93, 94, 95, 96, 97, 98, 99, 100, 101, 102, 103, 104, 105, 106, 107, 108, 109, 110, 111, 112, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 150, 151, 152, 153, 154, 155, 156, 157, 158, 159, 160, 161, 162, 163, 165, 1837, 1838, 1839, 1840, 1841, 1842, 1843, 1844 | TEM |
| SEQ ID No. 222 | NMGDHVTR | 152-159 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 119, 120, 121, 122, 123, 124, 125, 126, 127, 128, 129, 130, 131, 132, 133, 134, 135, 136, 137, 138, 139, 140, 141, 142, 143, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | 2be |
| SEQ ID No. 223 | QIAEICASLIK | 274-284 for the protein of SEQ No. 158 | TEM |
| SEQ ID No. 224 | QIAEIGASLIK | 274-284 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 93, 94, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 141, 142, 143, 144, 145, 146, 147, 148, 149, 150, 151, 153, 154, 155, 156, 157, 159, 160, 161, 162, | TEM |

-continued

| Peptide SEQ ID No. | Amino acid sequence | Position of the peptide in the TEM protein(s) | Clinical interest |
|---|---|---|---|
| | | 163, 164, 1837, 1838, 1839, 1840, 1841, 1842, 1843, 1844; 273-283 for the protein of sequence SEQ ID No. 165 | |
| SEQ ID No. 225 | QIAEIGGSLIK | 274-284 for the protein of SEQ No. 140 | 2be |
| SEQ ID No. 226 | QIVEIGASLIK | 274-284 for the proteins of SEQ No. 92, 95 | 2be |
| SEQ ID No. 227 | QQLIDWMADK | 203-212 for the protein of SEQ No. 165 | 2be |
| SEQ ID No. 228 | QQLIDWMEADK | 203-213 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 163, 164, 1837, 1838, 1839, 1840, 1841, 1842, 1843, 1844 | TEM |
| SEQ ID No. 229 | QQLIDWMEVDK | 203-213 for the proteins of SEQ No. 160, 161, 162 | TEM |
| SEQ ID No. 230 | QTAEIGASLIK | 274-284 for the protein of SEQ No. 152 | 2be |
| SEQ ID No. 231 | SALPAGWFIADK | 221-232 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 137, 138, 139, 140, 141, 142, 143, 144, 145, 146, 147, 148, 149, 150, 151, 152, 153, 154, 156, 157, 158, 159, 160, 161, 162, 164, 1837, 1838, 1839, 1840, 1841, 1842, 1843, 1844; 220-231 for the protein of sequence SEQ ID No. 165 | TEM |
| SEQ ID No. 232 | SGADER | 233-238 for the protein of SEQ No. 102 | TEM |
| SEQ ID No. 233 | SGAGER | 233-238 for the proteins of SEQ No. 1, 2, 6, 7, 9, 11, 12, 13, 15, 16, 17, 24, 27, 28, 29, 30, 31, 32, 33, 34, 35, 36, 37, 38, 39, 41, 42, 43, 49, 51, 52, 53, 54, 55, 56, 57, 58, 60, 61, 63, 65, 68, 69, 70, 71, 72, 73, 74, 75, 76, 77, 78, 79, 82, 85, 90, 91, 93, 94, 95, 96, 97, 99, 100, 101, 106, 107, 108, 109, 112, 114, 115, 116, 117, 118, 119, 123, 125, 130, 132, 134, 135, 136, 137, 139, 140, 142, 144, 145, 146, 147, | TEM |

-continued

| Peptide SEQ ID No. | Amino acid sequence | Position of the peptide in the TEM protein(s) | Clinical interest |
|---|---|---|---|
| | | 148, 149, 150, 151, 152, 153, 154, 156, 157, 158, 159, 160, 161, 162, 163, 1837, 1838, 1839, 1843, 1844 | |
| SEQ ID No. 234 | SGAGVR | 233-238 for the protein of SEQ No. 138 | 2be |
| SEQ ID No. 235 | SGANER | 233-238 for the protein of SEQ No. 131 | TEM |
| SEQ ID No. 236 | SGASER | 233-238 for the proteins of SEQ No. 3, 4, 8, 14, 18, 19, 20, 23, 48, 50, 62, 83, 84, 87, 89, 98, 103, 104, 110, 113, 124, 128, 129, 155 | 2be |
| SEQ ID No. 237 | SGASK | 233-237 for the proteins of SEQ No. 40, 45, 46, 47, 64, 66, 67, 88, 92, 1840, 1841, 1842 | 2be |
| SEQ ID No. 238 | SGGSER | 233-238 for the protein of SEQ No. 21 | 2be |
| SEQ ID No. 239 | SGTGER | 233-238 for the proteins of SEQ No. 120, 121 | 2be |
| SEQ ID No. 240 | SVLPAGWFIADK | 221-232 for the proteins of SEQ No. 136, 155, 163 | 2be |
| SEQ ID No. 241 | VAEPLLR | 214-220 for the protein of SEQ No. 53 | 2b |
| SEQ ID No. 242 | VAGPLLR | 214-220 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 1837, 1838, 1839, 1840, 1841, 1842, 1843, 1844; 213-219 for the protein of sequence SEQ ID No. 165 | TEM |
| SEQ ID No. 243 | VAGPLMR | 214-220 for the protein of SEQ No. 134 | 2br |
| SEQ ID No. 244 | VALIPFFAAFCFPVFAHPETLVK | 8-30 for the proteins of SEQ No. 4, 9, 23, 46, 47, 51, 60, 68, 69, 70, 80, 81, 89, 93, 101, 106, 108, 110, 121, 123, 147, 155, 1841, 1842 | TEM |
| SEQ ID No. 245 | VALIPFFAAFCIPVFAHPETLVK | 8-30 for the protein of SEQ No. 63 | 2br |
| SEQ ID No. 246 | VALIPFFAAFCLPVFAHPDTLVK | 8-30 for the protein of SEQ No. 139 | TEM |
| SEQ ID No. 247 | VALIPFFAAFCLPVFAHPETLVK | 8-30 for the proteins of SEQ No. 1, 2, 3, 5, 6, 7, 8, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 48, 49, 50, 52, 53, 54, 55, 56, 57, 58, 59, 61, 62, 64, 65, 66, 67, 71, 72, 73, 74, 75, 76, 77, 78, 79, 82, 83, 84, 85, 86, 87, 88, 90, 91, 92, 94, 95, 96, | TEM |

-continued

| Peptide SEQ ID No. | Amino acid sequence | Position of the peptide in the TEM protein(s) | Clinical interest |
|---|---|---|---|
| | | 97, 98, 99, 100, 102, 103, 104, 105, 107, 109, 111, 112, 113, 114, 116, 117, 118, 119, 120, 122, 124, 125, 126, 127, 128, 129, 130, 131, 132, 133, 134, 135, 136, 137, 138, 140, 141, 142, 143, 144, 145, 146, 148, 149, 151, 152, 153, 154, 156, 157, 158, 159, 160, 161, 162, 163, 164, 165, 1837, 1838, 1839, 1840, 1843, 1844 | |
| SEQ ID No. 248 | VALIPFFAAFCLPVFAHPK | 8-26 for the protein of SEQ No. 150 | TEM |
| SEQ ID No. 249 | VALIPFLAAFCLPVFAHPETLVK | 8-30 for the protein of SEQ No. 115 | 2be |
| SEQ ID No. 250 | VDAGQEQLDR | 82-91 for the proteins of SEQ No. 55, 62 | TEM |
| SEQ ID No. 251 | VDAGQEQLGR | 82-91 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 56, 57, 58, 59, 60, 61, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 146, 147, 148, 149, 151, 152, 153, 154, 155, 156, 157, 158, 160, 161, 162, 163, 164, 165, 1837, 1838, 1839, 1840, 1841, 1842, 1843, 1844 | TEM |
| SEQ ID No. 252 | VEDAEDQLGAR | 31-41 for the protein of SEQ No. 130 | 2b |
| SEQ ID No. 253 | VGYIELDLNSGK | 42-53 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 1837, 1838, 1839, 1840, 1841, 1842, 1843, 1844 | TEM |
| SEQ ID No. 254 | VGYIELDPNSGK | 42-53 for the protein of SEQ No. 58 | 2be |
| SEQ ID No. 255 | VGYIEMDLNSGK | 42-53 for the protein of SEQ No. 129 | 2be |
| SEQ ID No. 256 | VKPAEDK | 31-37 for the protein of SEQ No. 120 | 2be |
| SEQ ID No. 257 | VLLCGAELSR | 72-81 for the protein of SEQ No. 99 | TEM |

-continued

| Peptide SEQ ID No. | Amino acid sequence | Position of the peptide in the TEM protein(s) | Clinical interest |
|---|---|---|---|
| SEQ ID No. 258 | VLLCGAVLSR | 72-81 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | TEM |
| SEQ ID No. 259 | WEPELNEAIPIDER | 163-176 for the protein of SEQ No. 128 | 2be |
| SEQ ID No. 260 | WEPELNEAIPNDER | 163-176 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 74, 75, 76, 77, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 116, 117, 118, 119, 120, 121, 123, 124, 125, 126, 127, 129, 130, 131, 132, 133, 134, 135, 136, 137, 138, 139, 140, 141, 142, 143, 144, 145, 146, 147, 148, 149, 150, 151, 152, 153, 154, 155, 156, 158, 159, 160, 161, 162, 163, 164, 1837, 1838, 1839, 1840, 1841, 1842, 1843, 1844 | TEM |
| SEQ ID No. 261 | YSPVTEK | 103-109 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | 2be |
| SEQ ID No. 1923 | DAEDK | 33-37 for the proteins of SEQ No. 2, 3, 7, 8, 11, 13, 15, 17, 20, 21, 22, 40, 42, 44, 54, 57, 58, 59, 61, 62, 63, 67, 84, 92, 104, 105, 111, 119, 124, 129, 143, 148, 164, 1839 | TEM |

-continued

| Peptide SEQ ID No. | Amino acid sequence | Position of the peptide in the TEM protein(s) | Clinical interest |
|---|---|---|---|
| SEQ ID No. 1924 | GIIAALGPDGK | 242-252 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 1837, 1838, 1839, 1840, 1841, 1842, 1843, 1844; 241-251 for the protein of sequence SEQ ID No. 165 | TEM |
| SEQ ID No. 1925 | GSSGIIAALGPDGK | 239-252 for the proteins of SEQ No. 28, 42, 56, 69, 72, 111, 160, 161, 1844 | TEM |
| SEQ ID No. 1926 | ILESFR | 54-59 for the proteins of SEQ No. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 1837, 1838, 1839, 1840, 1841, 1842, 1843, 1844 | TEM |
| SEQ ID No. 1927 | SGAGK | 233-237 for the proteins of SEQ No. 10, 25, 26, 44, 59, 80, 86, 122, 133, 141, 143 | 2be |
| SEQ ID No. 1928 | SGTGK | 233-237 for the proteins of SEQ No. 5, 22, 81, 105, 111, 126, 164 | 2be |

In the clinical interest column, the entries 2b, 2br, 2be and 2ber correspond to the functional subgroups of TEM beta-lactamases which the corresponding peptide makes it possible to detect. Thus, the detection of a 2be peptide indicates the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The entry TEM indicates a common peptide between at least two of the subgroups 2b, 2br and 2be or 2ber. The corresponding peptide indicates the presence of a TEM beta-lactamase and the presence of a mechanism of resistance to at least penicillins and first-generation cephalosporins.

The detection of a mechanism of resistance to ESBL (extended-spectrum beta-lactamase) cephalosporins, induced by the TEM protein, is characterised by the detection of at least one resistance-marking 2be peptide, chosen from the sequences SEQ ID No. 168, SEQ ID No. 169, SEQ ID No. 179, SEQ ID No. 181, SEQ ID No. 186, SEQ ID No. 199, SEQ ID No. 200, SEQ ID No. 205, SEQ ID No. 206, SEQ ID No. 208, SEQ ID No. 212, SEQ ID No. 213, SEQ ID No. 214, SEQ ID No. 215, SEQ ID No. 216, SEQ ID No. 217, SEQ ID No. 222, SEQ ID No. 225, SEQ ID No. 226, SEQ ID No. 227, SEQ ID No. 230, SEQ ID No. 234, SEQ ID No. 236, SEQ ID No. 237, SEQ ID No. 238, SEQ ID No. 239, SEQ ID No. 240, SEQ ID No. 249, SEQ ID No. 254, SEQ ID No. 255, SEQ ID No. 256, SEQ ID No. 259, SEQ ID No. 261, SEQ ID No. 1927, SEQ ID No. 1928.

The detection of a mechanism of resistance to cephalosporins induced by the expression of the CMY protein is characterised by the detection of at least one peptide belonging to the CMY protein and to its different sequence variants SEQ ID No. 262 to SEQ ID No. 311 and SEQ ID No. 1844 to SEQ ID No. 1870.

```
SEQ ID No. 262:
MQQRQSILWGAVATLMWAGLAHAGEASPVDPLRPVVDASIQPLLKEHRIPGMAVAV

LKDGKAHYFNYGVANRESGASVSEQTLFEIGSVSKTLTATLGAYAVVKGAMQLDDK

ASRHAPWLKGSVFDSITMGELATYSAGGLPLQFPEEVDSSEKMRAYYRQWAPVYS

PGSHRQYSNPSIGLFGHLAASSLKQPFAQLMEQTLLPGLGMHHTYVNVPKQAMAS

YAYGYSKEDKPIRVNPGMLADEAYGIKTSSADLLAFVKANIGGVDDKALQQAISLTH

KGHYSVGGMTQGLGWESYAYPVTEQTLLAGNSAKVILEANPTAAPRESGSQVLFN

KTGSTNGFGAYVAFVPARGIGIVMLANRNYPIPARVKAAHAILAQLAG

SEQ ID No. 263:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVILEANPTAAPRESGSQVLFN

KTGSTNGFGAYVAFVPARGIGIVMLANRNYPIEARIKAAHAILAQLAG

SEQ ID No. 264:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVSLEANPTAAPRESGSQVLFN

KTGSTNGFGAYVAFVPARGIGIVMLANRNYPIEARIKAAHAILAQLAG

SEQ ID No. 265:
MMKKSLCCALLLTASFSTFASAKTEQQIADIVNRTITPLMQEQAIPGMAVAIIYQGKPY

YFTWGKADIANNHPVTQQTLFELGSVSKTFNGVLGGDAIARGEIKLSDPVTKYWPEL

TGKQWQGISLLHLATYTAGGLPLQIPDDVTDKAALLRFYQNWQPQWAPGAKRLYA

NSSIGLFGALAVKPSGMSYEEAMTRRVLQPLKLAHTWITVPQNEQKDYAWGYREG

KPVHVSPGQLDAEAYGVKSNVTDMARWVQVNMDASRVQEKTLQQGIALAQSRYW

RIGDMYQGLGWEMLNWPLKADSIINGSDSKVALAALPAVEVNPPAPAVKASWVHKT

GSTGGFGSYVAFVPEKNLGIVMLANKSYPNPVRVEAAWRILEKLQ

SEQ ID No. 266:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAFAALPAVEVNPPAPAVKASWVH

KTGSTGGFGSYVAFVPEKNLGIVMLANKSYPNPVRVEAAWRILEKLQ
```

-continued

SEQ ID No. 267:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGNGSDSKVALAALPAVEVNPPAPAVKASW

VHKTGSTGGFGSYVAFVPEKNLGIVMLANKSYPNPVRVEAAWRILEKLQ

SEQ ID No. 268:
MKKSLCCALLLTASFSTFAAAKTEQQIADIVNRTITPLMQEQAIPGMAVAVIYQGKPY

YFTWGKADIANNHPVTQQTLFELGSVSKTFNGVLGGDAIARGEIKLSDPVTKYWPEL

TGKQWQGISLLHLATYTAGGLPLQIPDDVTDKAALLHFYQNWQPQWTPGAKRLYA

NSSIGLFGALAVKPSGMSYEEAMTRRVLQPLKLAHTWITVPQNEQKDYAWGYREG

KPVHVSPGQLDAEAYGVKSSVIDMARWVQANMDASHVQEKTLQQGIALAQSRYW

RIGDMYQGLGWEMLNWPLKADSIINGSDNKVALAALPAVEVNPPAPAVKASWVHKT

GSTGGFGSYVAFVPEKNLGIVMLANKSYPNPVRVEAAWRILEKLQ

SEQ ID No. 269:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGKLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 270:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAYWRILEKLQ

SEQ ID No. 271:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAGAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 272:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGISLLHLATYTAGGLPLQIPDDVTDKAALLHFYQNWQPQWTPGAKRLY

ANSSIGLFGALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 273:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKAVHVSPGQLDAEAYGVKSSVIDMARWVQVNMDASRVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 274:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVYVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 275:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDNKVALAALPAVEVNPPAPAVKASWVH

KTGSTGGFGSYVAFVPEKNLGIVMLANKSYPNPVRVEAAWRILEKLQ

SEQ ID No. 276:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGRLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 277:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQFPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

-continued

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 278:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHGSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 279:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDCIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPENEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 280:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVTDKAALLHFYQNWQPQWTPGAKRLY

ANSSIGLFGALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 281:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYACGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 282:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGISLLHLATYTAGGLPLQIPDDVTDKAALLRFYQNWQPQWTPGAKRLY

ANSSIGLFGTLAVKPSGMSYEEAMTRRVLQPLKLAHTWITVPQSEQKDYAWGYRE

GKPVHVSPGQLDAEAYGVKSSVIDMAHWVQANMDASHVQEKTLQQGIELAQSRY

WRIGDMYQGLGWEMLNWPLKADSIINGSDSKVALAALPAVEVNPPAPAVKASWVH

KTGYTGGFGSYVAFVPEKNLGIVMLANKSYPNPVRVEAAWRILEKLQ

SEQ ID No. 283:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPEQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 284:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAALPAVEVNPPAPAVKASWVHKT

GSTGGFGSYVAFVPEKNLGIVMLANKSYPNPVRVEAAWRILEKLQ

SEQ ID No. 285:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFAALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 286:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAPAVEVNPPAPAVKASWVHKTGS

TGGFGSYVAFVPEKNLGIVMLANKSYPNPVRVEAAWRILEKLQ

SEQ ID No. 287:
MMKKSLCCALLLTASFSTFAAAKTEQQIADIVNRTITPLMQEQAIPGMAVAIIYQGKPY

YFTWGKADIANNHPVTQQTLFELGSVSKTFNGVLGGDAIARGEIKLSDPVTKYWPEL

TGKQWQGISLLHLATYTAGGLPLQIPDDVTDKAALLRFYQNWQPQWTPGAKRLYA

NSSIGLFGALAVKPSGMSYEEAMTRRVLQPLKLAHTWITVPQNEQKDYAWGYREG

KPVHVTPGQLDAEAYGVKSNVTDMARWIQVNMDASRVQEKTLQQGIALAQSRYW

RIGDMYQGLGWEMLNWPLKADSIINGSDSKVALAALHTVEVNPPAPAVKASWVHKT

GSTGGFGSYVAFIPEKNLGIVMLANKSYPNPVRVEAAWRILEKLQ

SEQ ID No. 288:
MMKKSICCALLLTASFSTFAAAKTEQQIADIVNRTITPLMQEQAIPGMAVAIIYEGKPY

YFTWGKADIANNHPVTQQTLFELGSVSKTFNGVLGGDAIARGEIKLSDPVTKYWPEL

TGKQWRGISLLHLATYTAGGLPLQIPDEVTDKAELLRFYQNWQPQWTPGAKRLYAN

SSIGLFGALVVKPSGMSYEEAMTRRVLQPLKLAHTWITVPQSEQKNYAWGYREGK

PVHVSPGQLDAEAYGVKSSVIDMARWVQANMDASHVQEKTLQQGIELAQSRYWRI

GDMYQGLGWEMLNWPLKADSIINGSDSKVALAALPAVEVNPPAPAVKASWVHKTG

STGGFGSYVAFVPEKNLGIVMLANKSYPNPARVEAAWRILEKLQ

SEQ ID No. 289:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLELDAEAYGVKSSVIDMARWVQANMDASHVQEKTLQQGIALAQS

RYWRIGDMYQGLGWEMLNWPLKADSIINGSDSKVALAALPAVEVNPPAPAVKASW

VHKTGSTGGFGSYVAFVPEKNLGIVMLANKSYPNPVRVEAAWRILEKLQ

SEQ ID No. 290:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGEAIARGEIKLSDPVTKYWPE

LTGKQWQGIRLLHLATYTAGGLPLQIPDDVRDKAALLHFYQNWQPQWTPGAKRLY

ANSSIGLFGALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 291:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQFDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 292:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKTDSIINGSDSKVALAALPAVEVNPPAPAVKASWVH

KTGSTGGFGSYVAFVPEKNLGIVMLANKSYPNPVRVEAAWRILEKLQ

SEQ ID No. 293:
MQQRQSILWGAVATLMWAGLAHAGEASPVDPLRPVVDASIQPLLKEHRIPGMAVAV

LKDGKAHYFNYGVANRESGASVSEQTLFDIGSVSKTLTATLGAYAVVKGAMQLDDK

ASRHAPWLKGSVFDSITMGELATYSAGGLPLQFPEEVDSSEKMRAYYRQWAPVYS

PGSHRQYSNPSIGLFGHLAASSLKQPFAQLMEQTLLPGLGMHHTYVNVPKQAMAS

YAYGYSKEDKPIRVNPGMLADEAYGIKTSSADLLAFVKANIGGVDDKALQQAISLTH

-continued

KGHYSVGGMTQGLGWESYAYPVTEQTLLAGNSAKVILEANPTAAPRESGSQVLFN

KTGSTNGFGAYVAFVPARGIGIVMLANRNYPIPARVKAAHAILAQLAG

SEQ ID No. 294:
MQQRQSILWGAVATLMWAGLAHAGEASPVDPLRPVVDASIQPLLKEHRIPGMAVAV

LKDGKAHYFNYGVANRESGASVSEQTLFDIGSVSKTLTATLGAYAVVKGAMQLDDK

ASRHAPWLKGSVFDSITMGELATYSAGGLPLQFPEEVDSSEKMRAYYRQWAPVYS

PGSHRQYSNPSIGLFGHLAASSLKQPFAQLMEQTLLPGLGMHHTYVNVPKQAMAS

YAYGYSKEDKPIRVNPGMLADEAYGIKTSSADLLAFVKANIGGVDDKALQQAISLTH

KGHYSVGGMTQGLGWESYAYPVTEQTLLAGNSAKVSLEANPTAAPRESGSQVLFN

KTGSTNGFGAYVAFVPARGIGIVMLANRNYPIPARVKAAHAILAQLAG

SEQ ID No. 295:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWS

ELTGKQWQGISLLHLATYTAGGLPLQIPDDVTDKTALLHFYQNWQPQWAPGAKRLY

ANSSIGLFGALAVKPSGMSYEEAMTRRVLQPLKLAHTWITVPQSEQKDYAWGYRE

GKPVHVSPGQLDAEAYGVKSSVIDMARWVQANMDASRVQEKTLQQGIALAQSRY

WRIGDMYQGLGWEMLNWPLKADSIINGSDSKVALAAIPAVEVNPPAPAVKASWVHK

TGSTGGFGSYVAFVPEKNLGIVMLANKSYPNPIRVEAAWRILEKLQ

SEQ ID No. 296:
MMKKSLCCALLLTASFSTFASAKTEQQIADIVNRTITPLMQEQAIPGMAVAVIYQGKT

YYFTWGKADIANNHPVTQQTLFELGSVSKTFNGVLGGDAIARGEIKLSDPVTKYWP

ELTGKQWQDISLLHLATYTAGGLPLQIPDDVTDKTALLHFYQNWQPQWAPGAKRLY

ANSSIGLFGALAVKPSGMSYEEAMTRRVLQPLKLAHTWITVPQSEQKDYAWGYRE

GKPVHVSPGQLDAEAYGVKSNVTDMARWVQVNMDASRVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 297:
MMKKSLCCALLLTAPLSTFAAAKTEQQIADIVNRTITPLMQEQAIPGMAVAVIYQGKP

YYFTWGKADITNNHPVTQQTLFELGSVSKTFNGVLGGDAIARGEIKLSDPVTKYWPE

LTGKQWQGISLLHLATYTAGGLPLQIPDDVTDKAALLRFYQNWQPQWAPGAKRLYA

NSSIGLFGALAVKPSGMSYEEAMTRRVLQPLKLAHTWIKVPQSEQKDYAWGYREG

KAVHVSPGQLDAEAYGVKSSVIDMARWVQVNMDASRVQEKTLQQGIALAQSRYW

RIGDMYQGLGWEMLNWPLKADSIINGSDSKVALAALPAVEVNPPAPAVKASWVHKT

GSTGGFGSYVAFVPEKNLGIVMLANKSYPNPVRVEAAWRILEKLQ

SEQ ID No. 298:
MMKKSICCALLLTASFSTFAATKTEQQIADIVNRTITPLMQEQAIPGMAVAIIYEEKPY

YFTWGKADIANNHPVTQQTLFELGSVSKTFNGVLGGDAIARGEIKLSDPVTKYWPEL

TGKQWRGISLLHLATYTAGGLPLQIPDEVTDKAALLRFYQNWQPQWTPGAKRLYAN

SSIGLFGALAVKPSGMSYEEAMTRRVLQPLKLAHTWITVPQSEQKNYAWGYREGK

PVHVSPGQLDAEAYGVKSSVIDMARWVQANMDASHVQEKTLQQGIELAQSRYWRI

GDMYQGLGWEMLNWPLKADSIINGSDSKVALAALPAVEVNPPAPAVKASWVHKTG

STGGFGSYVAFVPEKNLGIVMLANKSYPNPARVEAAWRILEKLQ

SEQ ID No. 299:
GPGHLFAFNYGTDFMMKKSLCCALLLTASFSTFAAAKTEQQIADIVNRTITPLMQEQ

AIPGMAVAVIYQGKPYYFTWGKADIANNHPVTQQTLFELGSVSKTFNGVLGGDAIAR

GEIKLSDPVTKYWPELTGKQWQGIRLLHLATYTAGGLPLQIPDDVRDKAALLHFYQN

WQPQWTPGAKRLYANSSIGLFGALAVKPSGMSYEEAMTRRVLQPLKLAHTWITVP

QNEQKDYAWGYREGKPVHASPGQLDAEAYGVKSSVIDMARWVQANMDASHVQE

KTLQQGIALAQSRYWRIGDMYQGLGWEMLNWPLKADSIINGSDSKVALAALPAVEV

NPPAPAVKASWVHKTGSTGGFGSYVAFVPEKNLGIVMLANKSYPNPVRVEAAWRIL

EKLQ

SEQ ID No. 300:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 301:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVILEANPTAAPRESGSQVLFN

KTGSTNGFGAYVAFVPARGIGIVMLANRNYPNEARIKAAHAILAQLAG

SEQ ID No. 302:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 303:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 304:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YSNSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKNYPNPVRVEAAWRILEKLQ

SEQ ID No. 305:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 306:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYALGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 307:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKFSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 308:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKNYPNPVRVEAAWRILEKLQ

SEQ ID No. 309:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

-continued

WRIGDMYQGLGWEMLNWPLKADSIINGSDSKVALAALPAVEINPPAPAVKASWVHK

TGSTGGFGSYVAFVPEKNLGIVMLANKSYPNPVRVEAAWRILEKLQ

SEQ ID No. 310:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YSNSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 311:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLNAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKNYPNPVRVEAAWRILEKLQ

SEQ ID No. 1844:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVILEANPTAAPRESGSQVLFN

KTGSTNGFGAYVAFVPARGIGIVMLANRNYPIEARIKAAHAILAQLAG

SEQ ID No. 1845:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVSLEANPTAAPRESGSQVLFN

KTGSTNGFGAYVAFVPARGIGIVMLANRNYPIEARIKAAHAILAQLAG

SEQ ID No. 1846:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAFAALPAVEVNPPAPAVKASWVH

KTGSTGGFGSYVAFVPEKNLGIVMLANKSYPNPVRVEAAWRILEKLQ

SEQ ID No. 1847:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGNGSDSKVALAALPAVEVNPPAPAVKASW

VHKTGSTGGFGSYVAFVPEKNLGIVMLANKSYPNPVRVEAAWRILEKLQ

SEQ ID No. 1848:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAYWRILEKLQ

SEQ ID No. 1849:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDNKVALAALPAVEVNPPAPAVKASWVH

KTGSTGGFGSYVAFVPEKNLGIVMLANKSYPNPVRVEAAWRILEKLQ

SEQ ID No. 1850:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAALPAVEVNPPAPAVKASWVHKT

GSTGGFGSYVAFVPEKNLGIVMLANKSYPNPVRVEAAWRILEKLQ

SEQ ID No. 1851:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVAPAVEVNPPAPAVKASWVHKTGS

TGGFGSYVAFVPEKNLGIVMLANKSYPNPVRVEAAWRILEKLQ

SEQ ID No. 1852:
MMKKSLCCALLLTASFSTFAAAKTEQQIADIVNRTITPLMQEQAIPGMAVAVLYQGKP

YYFTWGKADIANNHPVTQQTLFELGSVSKTFNGVLGGDAIARGEIKLSDPVTKYLPE

LTGKQWQGISLLHLATYTAGGLPLQIPDDVTDKAALLRFYQNWQPQWTPGAKRLYA

NSSIGLFGALAVKPSGMSYEEAMTRRVLQPLKLAHTWITVPQNEQKDYAWGYREG

KPVHVTPGQLDAEAYGVKSNVTDMARWIQVNMDASRVQEKTLQQGIALAQSRYW

RIGDMYQGLGWEMLNWPLKADSIINGSDSKVALAALPTVEVNPPAPAVKASWVHKT

GSTGGFGSYVAFVPEKNLGIVMLANKSYPNPVRVEAAWRILEKLQ

SEQ ID No. 1853:
MMKKSICCALLLTASFSTFAAAKTEQQIADIVNRTITPLMQEQAIPGMAVAIIYEGKPY

YFTWGKADIANNHPVTQQTLFELGSVSKTFNGVLGGDAIARGEIKLSDPVTKYWPEL

TGKQWRGISLLHLATYTAGGLPLQIPDDVTDKAALLRFYQNWQPQWTPGAKRLYAN

SSIGLFGALAVKPSGMSYEEAMTRRVLQPLKLAHTWITVPQSEQKNYAWGYREGK

PVHVSPGQLDAEAYGVKSSVIDMARWVQANMDASHVQEKTLQQGIELAQSRYWRI

GDMYQGLGWEMLNWPLKADSIINGSDSKVALAALPAVEVNPPAPAVKASWVHKTG

STGGFGSYVAFVPEKNLGIVMLANKSYPNPARVEAAWRILEKLQ

SEQ ID No. 1854:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKTDSIINGSDSKVALAALPAVEVNPPAPAVKASWVH

KTGSTGGFGSYVAFVPEKNLGIVMLANKSYPNPVRVEAAWRILEKLQ

SEQ ID No. 1855:
MMKKSLCCALLLTASLSTFAAAKTEQQIADIVNRTITPLMQEQAIPGMAIAVIYQGKPY

YFTWGKADITNNHPVTQQTLFELGSVSKTFNGVLGGDAIARGEIKLSDPVTKYWPEL

TGKQWQGISLLHLATYTAGGLPLQIPDDVTDKAALLRFYQNWQPQWAPGAKRLYA

NSSIGLFGALAVKPSGMSYEEAMTRRVLQPLKLAHTWITVPQNEQKDYAWGYREG

KAVHVSPGQLDAEAYGVKSSVIDMARWVQVNMDASRVQEKTLQQGIALAQSRYW

RIGDMYQGLGWEMLNWPLKADSIINGSDSKVALAALPAVEVNPPAPAVKASWVHKT

GSTGGFGSYVAFVPEKNLGIVMLANKSYPNPVRVEAAWRILEKLQ

SEQ ID No. 1856:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYCVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1857:
MMKKSLCCALLLTASFSTFAAAKTEQQIADIVNRTITPLMQEQAIPGMAVAVIYQGKP

YYFTWGKADIANNHPVTQQTLFELGSVSKTFIGVLGGDAIARGEIKLSDPVTKYWPE

LTGKQWQGIRLLHLATYTAGGLPLQIPDDVRDKAALLHFYQNWQPQWTPGAKRLY

ANSSIGLFGALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

-continued

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1858:
MMNRYAAALLLTASFSTFAAAKTEQQIADIVNRTITPLMQEQAIPGMAVAVIYQGKPY

YFTWGKADIANNHPVTQQTLFELGSVSKTFNGVLGGDAIARGEIKLSDPVTKYWPEL

TGKQWQGIRLLHLATYTAGGLPLQIPDDVRDKAALLHFYQNWQPQWTPGAKRLYA

NSSIGLFGALAVKPSGMSYEEAMTRRVLQPLKLAHTWITVPQNEQKDYAWGYREG

KPVHVSPGQLDAEAYGVKSSVIDMARWVQANMDASHVQEKTLQQGIALAQSRYW

RIGDMYQGLGWEMLNWPLKADSIINGSDSKVALAALPAVEVNPPAPAVKASWVHKT

GSTGGFGSYVAFVPEKNLGIVMLANKSYPNPVRVEAAWRILEKLQ

SEQ ID No. 1859:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFSALAVKPSGMSYEEAMTRRVLQPLKLAHTWITVPQNEQKDYAWGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1860:
MQQRQSILWGAVATLMWAGLAHAGEASPVDPLRPVVDASIQPLLKEHRIPGMAVAV

LKDGKAHYFNYGVANRESGASVSEQTLFDIGSVSKTLTATLGAYAVVKGAMQLDDK

ASRHAPWLKGSVFDSITMGELATYSAGGLPLQFPEEVDSSEKMRAYYRQWAPVYS

PGSHRQYSNPSIGLFGHLAASSLKQPFAQLMEQTLLPGLGMHHTYVNVPKQAMAS

YAYGYSKEDKPIRVNPGMLADEAYGIKTSSADLLAFVKANIGGVDDKALQQAISLTH

KGHYSVGGMTQGLGWESYAYPVTEQTLLAGNSAKVILEANPTAAPRESGSQVLFN

KTGSTNGFGAYVAFVPARGIGIVMLANRNYPIPARVKAAHAILAQLAG

SEQ ID No. 1861:
MQQRQSILWGAVATLMWAGLAHAGEASPVDPLRPVVDASIQPLLKEHRIPGMAVAV

LKDGKAHYFNYGVANRESGASVSEQTLFDIGSVSKTLTATLGAYAVVKGAMQLDDK

ASRHAPWLKGSVFDSITMGELATYSAGGLPLQFPEEVDSSEKMRAYYRQWAPVYS

PGSHRQYSNPSIGLFGHLAASSLKQPFAQLMEQTLLPGLGMHHTYVNVPKQAMAS

YAYGYSKEDKPIRVNPGMLADEAYGIKTSSADLLAFVKANIGGVDDKALQQAISLTH

KGHYSVGGMTQGLGWESYAYPVTEQTLLAGNSAKVSLEANPTAAPRESGSQVLFN

KTGSTNGFGAYVAFVPARGIGIVMLANRNYPIPARVKAAHAILAQLAG

SEQ ID No. 1862:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1863:
MQQRQSILWGAVATLMWAGLAHAGEASPVDPLRPVVDASIQPLLKEHRIPGMAVAV

LKDGKAHYFNYGVANRESGAGVSEQTLFEIGSVSKTLTATLGAYAVVKGAMQLDDK

ASRHAPWLKGSAFDSITMGELATYSAGGLPLQFPEEVDSSEKMRAYYRQWAPVYS

PGSHRQYSNPSIGLFGHLAASSLKQPFAPLMEQTLLPGLGMHHTYVNVPKQAMAS

YAYGYSKEDKPIRVNPGMLADEAYGIKTSSADLLRFVKANIGGVDDKALQQAISLTH

QGHYSVGGMTQGLGWESYAYPVTEQTLLAGNSAKVILEANPTAAPRESGSQVLFN

KTGSTNGFGAYVAFVPARGIGIVMLANRNYPNEARIKAAHAILAQLAG

SEQ ID No. 1864:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1865:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YSNSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKNYPNPVRVEAAWRILEKLQ

SEQ ID No. 1866:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGELAVKPSGMSYEEAMTRRVLQPLKLAHTWITVPQNEQKDYAWGYR

EGKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1867:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKNYPNPVRVEAAWRILEKLQ

SEQ ID No. 1868:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIPDDVRDKAALLHFYQNWQPQWTPGAKRL

-continued

```
YANSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEINPPAPAVKASWVHK

TGSTGGFGSYVAFVPEKNLGIVMLANKSYPNPVRVEAAWRILEKLQ

SEQ ID No. 1869:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLQIIDDDVRDKAALLHFYQNWQPQWTPGAKRL

YSNSSIGLFGALAVKPSGMSYEEAMTRRVLQPLKLAHTWITVPQNEQKDYARGYRE

GKPVHVSPGQLDAEAYGVKSSVIDMARWVQANMDASHVQEKTLQQGIALAQSRY

WRIGDMYQGLGWEMLNWPLKADSIINGSDSKVALAALPAVEVNPPAPAVKASWVH

KTGSTGGFGSYVAFVPEKNLGIVMLANKSYPNPVRVEAAWRILEKLQ

SEQ ID No. 1870:
MMKKSLCCALLLTASFSTFAAAKTEQQIADIVNRTITPLMQEQAIPGMAVAVIYQGKP

YYFTWGKADIANNHPVTQQTLFELGSVSKTFNGVLGGDAIARGEIKLSDPVTKYWP

ELTGKQWQGIRLLHLATYTAGGLPLKIPDDVRDKAALLHFYQNWQPQWTPGAKRLY

SNSSIGLFGALAVKPSGMSYEEAMTRRVLQPLKLAHTWITVPQNEQKDYARGYREG

KPVHVSPGQLDAEAYGVKSSVIDMARWVQANMDASHVQEKTLQQGIALAQSRYW

RIGDMYQGLGWEMLNWPLKADSIINGSDSKVALAALPAVEVNPPAPAVKASWVHKT

GSTVGFGSYVAFVPEKNLGIVMLANKSYPNPVRVEAAWRILEKLQ
``` said peptides being chosen, preferably, from the peptides of sequence SEQ ID No. 312 to SEQ ID No. 350, SEQ ID No. 734, SEQ ID No. 735 and SEQ ID No. 1929 to SEQ ID No. 2007, as defined hereafter:

| Peptide SEQ ID No. | Amino acid sequence | Position of the peptide in the CMY protein |
|---|---|---|
| SEQ ID No. 312 | AALLHFYQNWQPQWTPGAK | 149-167 for the proteins of SEQ No. 266, 267, 269, 270, 271, 272, 273, 274, 275, 276, 277, 278, 279, 280, 281, 283, 284, 285, 286, 289, 290, 291, 292, 300, 302, 303, 304, 305, 306, 307, 308, 309, 310, 311, 1846, 1847, 1848, 1849, 1850, 1851, 1854, 1856, 1857, 1859, 1862, 1864, 1865, 1866, 1867, 1868, 1869, 1870; 148-166 for the protein of sequence SEQ ID No. 268; 163-181 for the protein of sequence SEQ ID No. 299; 148-166 for the protein of sequence SEQ ID No. 1858 |
| SEQ ID No. 313 | ADIANNHPVTQQTLFELGSVSK | 66-87 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 295, 296, 298, 300, 302, 303, 304, 305, 306, 307, 308, 309, 310, 311, 1846, 1847, 1848, 1849, 1850, 1851, 1852, 1853, 1854, 1856, 1857, 1859, 1862, 1864, 1865, 1866, 1867, 1868, 1869, 1870; 65-86 for the protein of sequence SEQ ID No. 268; 80-101 for the protein of sequence SEQ ID No. 299; 65-86 for the protein of sequence SEQ ID No. 1858 |
| SEQ ID No. 314 | ADSIINGSDSK | 300-310 for the proteins of SEQ No. 265, 266, 269, 270, 271, 272, 273, 274, 276, 277, 278, 279, 280, 281, 282, 283, 284, 285, 286, 287, 288, 290, 291, 295, 296, 297, 298, 300, 302, 303, 304, 305, 306, 307, 308, 309, 310, 311, 1846, 1848, 1850, 1851, 1852, 1853, 1855, 1856, 1857, 1859, 1862, 1864, 1865, 1866, 1867, 1868, 1869, 1870; 302-312 for the protein of sequence SEQ ID No. 289; 314-324 for the protein of sequence SEQ ID No. 299; 299-309 for the protein of sequence SEQ ID No. 1858 |
| SEQ ID No. 315 | ASWVHK | 330-335 for the proteins of SEQ No. 265, 266, 269, 270, 271, 272, 273, 274, 275, 276, 277, 278, 279, 280, 281, 282, 283, 285, 287, 288, 290, 291, 292, 295, 296, 297, 298, 300, 302, 303, 304, 305, 306, 307, 308, 309, 310, 311, 1846, 1848, 1849, 1852, 1853, 1854, 1855, 1856, 1857, 1859, 1862, 1864, 1865, 1866, |

-continued

| Peptide SEQ ID No. | Amino acid sequence | Position of the peptide in the CMY protein |
|---|---|---|
| | | 1867, 1868, 1869, 1870; 332-337 for the protein of sequence SEQ ID No. 267; 329-334 for the protein of sequence SEQ ID No. 268; 328-333 for the protein of sequence SEQ ID No. 284; 326-331 for the protein of sequence SEQ ID No. 286; 332-337 for the protein of sequence SEQ ID No. 289; 344-349 for the protein of sequence SEQ ID No. 299; 332-337 for the protein of sequence SEQ ID No. 1847; 328-333 for the protein of sequence SEQ ID No. 1850; 326-331 for the protein of sequence SEQ ID No. 1851; 329-334 for the protein of sequence SEQ ID No. 1858 |
| SEQ ID No. 316 | DYAWGYR | 218-224 for the proteins of SEQ No. 265, 266, 267, 269, 270, 271, 272, 273, 274, 275, 276, 277, 278, 279, 280, 282, 283, 284, 285, 286, 287, 289, 290, 291, 292, 295, 296, 297, 300, 305, 307, 1846, 1847, 1848, 1849, 1850, 1851, 1852, 1854, 1855, 1856, 1857, 1859, 1862, 1866; 217-223 for the protein of sequence SEQ ID No. 268; 232-238 for the protein of sequence SEQ ID No. 299; 217-223 for the protein of sequence SEQ ID No. 1858 |
| SEQ ID No. 317 | IGDMYQGLGWEMLNWPLK | 282-299 for the proteins of SEQ ID No. 265, 266, 267, 269, 270, 271, 272, 273, 274, 275, 276, 277, 278, 279, 280, 281, 282, 283, 284, 285, 286, 287, 288, 290, 291, 292, 295, 296, 297, 298, 300, 302, 303, 304, 305, 306, 307, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 281-298 for the protein of sequence SEQ ID No. 268; 284-301 for the protein of sequence SEQ ID No. 289; 296-313 for the protein of sequence SEQ ID No. 299; 281-298 for the protein of sequence SEQ ID No. 1858 |
| SEQ ID No. 318 | LAHTWITVPQNEQK | 204-217 for the proteins of SEQ ID No. 265, 266, 267, 269, 270, 271, 272, 273, 274, 275, 276, 277, 278, 280, 281, 283, 284, 285, 286, 287, 289, 290, 291, 292, 300, 302, 303, 304, 305, 306, 307, 308, 309, 310, 311, 1846, 1847, 1848, 1849, 1850, 1851, 1852, 1854, 1855, 1856, 1857, 1859, 1862, 1864, 1865, 1866, 1867, 1868, 1869, 1870; 203-216 for the protein of sequence SEQ ID No. 268; 218-231 for the protein of sequence SEQ ID No. 299; 203-216 for the protein of sequence SEQ ID No. 1858 |
| SEQ ID No. 319 | LLHLATYTAGGLPLQIPDDVR | 126-146 for the proteins of SEQ ID No. 266, 267, 269, 270, 271, 273, 274, 275, 276, 278, 279, 281, 283, 284, 285, 286, 289, 290, 291, 292, 300, 302, 303, 304, 305, 306, 307, 308, 309, 310, 311, 1846, 1847, 1848, 1849, 1850, 1851, 1854, 1856, 1857, 1859, 1862, 1864, 1865, 1866, 1867, 1868, 1869; 140-160 for the protein of sequence SEQ ID No. 299; 125-145 for the protein of sequence SEQ ID No. 1858 |
| SEQ ID No. 320 | LSDPVTK | 105-111 for the proteins of SEQ ID No. 265, 266, 267, 269, 270, 271, 272, 273, 274, 275, 276, 277, 278, 279, 280, 281, 282, 283, 284, 285, 286, 287, 288, 289, 290, 291, 292, 295, 296, 297, 298, 300, 302, 303, 304, 305, 306, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 104-110 for the protein of sequence SEQ ID No. 268; 119-125 for the protein of sequence SEQ ID No. 299; 104-110 for the protein of sequence SEQ ID No. 1858 |
| SEQ ID No. 321 | LYANSSIGLFGALAVK | 169-184 for the proteins of SEQ ID No. 265, 266, 267, 270, 271, 272, 273, 274, 276, 278, 279, 280, 281, 283, 284, 286, 287, 289, 290, 291, 292, 295, 296, 297, 298, 300, 302, 303, 306, 307, 308, 309, 311, 1846, 1847, 1848, 1850, 1851, 1852, 1853, 1854, 1855, 1856, 1857, 1862, 1864, 1867, 1868; 168-183 for the protein of sequence SEQ ID No. 268; 183-198 for the protein of sequence SEQ ID No. 299; 168-183 for the protein of sequence SEQ ID No. 1858 |
| SEQ ID No. 322 | NLGIVMLANK | 353-362 for the proteins of SEQ ID No. 265, 266, 269, 270, 271, 272, 273, 274, 275, 276, 277, 278, 279, 280, 281, 282, 283, 285, 287, 288, 290, 291, 292, 295, 296, 297, 298, 300, 302, 303, 304, 305, 306, 307, 308, 309, 310, 311, 1846, 1848, 1849, 1852, 1853, 1854, 1855, 1856, 1857, 1859, 1862, 1864, 1865, 1866, 1867, 1868, 1869, 1870; 355-364 for the protein of sequence SEQ ID No. 267; 352-361 for the protein of sequence SEQ ID No. 268; 351-360 for the protein of sequence SEQ ID No. 284; 349-358 for the protein of sequence SEQ ID No. 286; 355-364 |

-continued

| Peptide SEQ ID No. | Amino acid sequence | Position of the peptide in the CMY protein |
|---|---|---|
| | | for the protein of sequence SEQ ID No. 289; 367-376 for the protein of sequence SEQ ID No. 299; 355-364 for the protein of sequence SEQ ID No. 1847; 351-360 for the protein of sequence SEQ ID No. 1850; 349-358 for the protein of sequence SEQ ID No. 1851; 352-361 for the protein of sequence SEQ ID No. 1858 |
| SEQ ID No. 323 | QWQGIR | 120-125 for the proteins of SEQ No. 266, 267, 269, 270, 271, 273, 274, 275, 276, 277, 278, 279, 280, 281, 283, 284, 285, 286, 289, 290, 291, 292, 300, 302, 303, 304, 305, 306, 307, 308, 309, 310, 311, 1846, 1847, 1848, 1849, 1850, 1851, 1854, 1856, 1857, 1859, 1862, 1864, 1865, 1866, 1867, 1868, 1869, 1870; 134-139 for the protein of sequence SEQ ID No. 299; 119-124 for the protein of sequence SEQ ID No. 1858 |
| SEQ ID No. 324 | SLCCALLLTASFSTFAAAK | 5-23 for the proteins of SEQ No. 266, 267, 269, 270, 271, 272, 273, 274, 275, 276, 277, 278, 279, 280, 281, 282, 283, 284, 285, 286, 287, 289, 290, 291, 292, 295, 300, 302, 303, 304, 305, 306, 307, 308, 309, 310, 311, 1846, 1847, 1848, 1849, 1850, 1851, 1852, 1854, 1856, 1857, 1859, 1862, 1864, 1865, 1866, 1867, 1868, 1869, 1870; 4-22 for the protein of sequence SEQ ID No. 268; 19-37 for the protein of sequence SEQ ID No. 299 |
| SEQ ID No. 325 | SSVIDMAR | 245-252 for the proteins of SEQ No. 266, 267, 269, 270, 271, 272, 273, 274, 275, 276, 277, 278, 279, 280, 281, 283, 284, 285, 286, 288, 290, 291, 292, 295, 297, 298, 300, 302, 303, 304, 305, 306, 307, 308, 309, 310, 311, 1846, 1847, 1848, 1849, 1850, 1851, 1853, 1854, 1855, 1856, 1857, 1859, 1862, 1864, 1865, 1866, 1867, 1868, 1869, 1870; 244-251 for the protein of sequence SEQ ID No. 268; 247-254 for the protein of sequence SEQ ID No. 289; 259-266 for the protein of sequence SEQ ID No. 299; 244-251 for the protein of sequence SEQ ID No. 1858 |
| SEQ ID No. 326 | SYPNPVR | 363-369 for the proteins of SEQ No. 265, 266, 269, 270, 271, 272, 273, 274, 275, 276, 277, 278, 279, 280, 281, 282, 283, 285, 287, 290, 291, 292, 296, 297, 300, 302, 303, 305, 306, 307, 309, 310, 1846, 1848, 1849, 1852, 1854, 1855, 1856, 1857, 1859, 1862, 1864, 1866, 1868, 1869, 1870; 365-371 for the protein of sequence SEQ ID No. 267; 362-368 for the protein of sequence SEQ ID No. 268; 361-367 for the protein of sequence SEQ ID No. 284; 359-365 for the protein of sequence SEQ ID No. 286; 365-371 for the protein of sequence SEQ ID No. 289; 377-383 for the protein of sequence SEQ ID No. 299; 365-371 for the protein of sequence SEQ ID No. 1847; 361-367 for the protein of sequence SEQ ID No. 1850; 359-365 for the protein of sequence SEQ ID No. 1851; 362-368 for the protein of sequence SEQ ID No. 1858 |
| SEQ ID No. 327 | TEQQIADIVNR | 24-34 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 295, 296, 297, 298, 300, 302, 303, 304, 305, 306, 307, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 23-33 for the protein of sequence SEQ ID No. 268; 38-48 for the protein of sequence SEQ ID No. 299; 23-33 for the protein of sequence SEQ ID No. 1858 |
| SEQ ID No. 328 | TFNGVLGGDAIAR | 88-100 for the proteins of SEQ No. 265, 266, 267, 269, 270, 271, 272, 273, 274, 275, 276, 277, 278, 280, 281, 282, 283, 284, 285, 286, 287, 288, 289, 291, 292, 295, 296, 297, 298, 300, 302, 303, 304, 305, 306, 307, 308, 309, 310, 311, 1846, 1847, 1848, 1849, 1850, 1851, 1852, 1853, 1854, 1855, 1856, 1859, 1862, 1864, 1865, 1866, 1867, 1868, 1869, 1870; 87-99 for the protein of sequence SEQ ID No. 268; 102-114 for the protein of sequence SEQ ID No. 299; 87-99 for the protein of sequence SEQ ID No. 1858 |
| SEQ ID No. 329 | TGSTGGFGSYVAFVPEK | 336-352 for the proteins of SEQ No. 265, 266, 269, 270, 271, 272, 273, 274, 275, 276, 277, 278, 279, 280, 281, 283, 285, 288, 290, 291, 292, 295, 296, 297, 298, 300, 302, 303, 304, 305, 306, 307, 308, 309, 310, 311, 1846, 1848, 1849, 1852, 1853, 1854, 1855, 1856, 1857, 1859, 1862, 1864, 1865, 1866, 1867, 1868, 1869; 338-354 for the protein of sequence SEQ ID No. 267; 335-351 for the protein of sequence SEQ ID No. 268; 334-350 |

-continued

| Peptide SEQ ID No. | Amino acid sequence | Position of the peptide in the CMY protein |
|---|---|---|
| | | for the protein of sequence SEQ ID No. 284; 332-348 for the protein of sequence SEQ ID No. 286; 338-354 for the protein of sequence SEQ ID No. 289; 350-366 for the protein of sequence SEQ ID No. 299; 338-354 for the protein of sequence SEQ ID No. 1847; 334-350 for the protein of sequence SEQ ID No. 1850; 332-348 for the protein of sequence SEQ ID No. 1851; 335-351 for the protein of sequence SEQ ID No. 1858 |
| SEQ ID No. 330 | TITPLMQEQAIPGMAVAVIYQGK | 35-57 for the proteins of SEQ No. 266, 267, 269, 270, 271, 272, 273, 274, 275, 276, 277, 278, 279, 280, 281, 282, 283, 284, 285, 286, 289, 290, 291, 292, 295, 296, 297, 300, 302, 303, 304, 305, 306, 307, 308, 309, 310, 311, 1846, 1847, 1848, 1849, 1850, 1851, 1854, 1856, 1857, 1859, 1862, 1864, 1865, 1866, 1867, 1868, 1869, 1870; 34-56 for the protein of sequence SEQ ID No. 268; 49-71 for the protein of sequence SEQ ID No. 299; 34-56 for the protein of sequence SEQ ID No. 1858 |
| SEQ ID No. 331 | TLQQGIALAQSR | 267-278 for the proteins of SEQ No. 265, 266, 267, 269, 270, 271, 272, 273, 274, 275, 276, 277, 278, 279, 280, 281, 283, 284, 285, 286, 287, 290, 291, 292, 295, 296, 297, 300, 302, 303, 304, 305, 306, 307, 308, 309, 310, 311, 1846, 1847, 1848, 1849, 1850, 1851, 1852, 1854, 1855, 1856, 1857, 1859, 1862, 1864, 1865, 1866, 1867, 1868, 1869, 1870; 266-277 for the protein of sequence SEQ ID No. 268; 269-280 for the protein of sequence SEQ ID No. 289; 281-292 for the protein of sequence SEQ ID No. 299; 266-277 for the protein of sequence SEQ ID No. 1858 |
| SEQ ID No. 332 | VALAALPAVEVNPPAPAVK | 311-329 for the proteins of SEQ No. 265, 269, 270, 271, 272, 273, 274, 275, 276, 277, 278, 279, 280, 281, 282, 283, 285, 288, 290, 291, 292, 296, 297, 298, 300, 302, 303, 304, 305, 306, 307, 308, 310, 311, 1848, 1849, 1853, 1854, 1855, 1856, 1857, 1859, 1862, 1864, 1865, 1866, 1867, 1869, 1870; 313-331 for the protein of sequence SEQ ID No. 267; 310-328 for the protein of sequence SEQ ID No. 268; 313-331 for the protein of sequence SEQ ID No. 289; 325-343 for the protein of sequence SEQ ID No. 299; 313-331 for the protein of sequence SEQ ID No. 1847; 310-328 for the protein of sequence SEQ ID No. 1858 |
| SEQ ID No. 333 | VEAAWR | 370-375 for the proteins of SEQ No. 265, 266, 269, 271, 272, 273, 274, 275, 276, 277, 278, 279, 280, 281, 282, 283, 285, 287, 288, 290, 291, 292, 295, 296, 297, 298, 300, 302, 303, 304, 305, 306, 307, 308, 309, 310, 311, 1846, 1849, 1852, 1853, 1854, 1855, 1856, 1857, 1859, 1862, 1864, 1865, 1866, 1867, 1868, 1869, 1870; 372-377 for the protein of sequence SEQ ID No. 267; 369-374 for the protein of sequence SEQ ID No. 268; 368-373 for the protein of sequence SEQ ID No. 284; 366-371 for the protein of sequence SEQ ID No. 286; 372-377 for the protein of sequence SEQ ID No. 289; 384-389 for the protein of sequence SEQ ID No. 299; 372-377 for the protein of sequence SEQ ID No. 1847; 368-373 for the protein of sequence SEQ ID No. 1850; 366-371 for the protein of sequence SEQ ID No. 1851; 369-374 for the protein of sequence SEQ ID No. 1858 |
| SEQ ID No. 334 | VLQPLK | 198-203 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 295, 296, 297, 298, 300, 302, 303, 304, 305, 306, 307, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 197-202 for the protein of sequence SEQ ID No. 268; 212-217 for the protein of sequence SEQ ID No. 299; 197-202 for the protein of sequence SEQ ID No. 1858 |
| SEQ ID No. 335 | WVQANMDASHVQEK | 253-266 for the proteins of SEQ No. 266, 267, 269, 270, 271, 272, 274, 275, 276, 277, 278, 279, 280, 281, 282, 283, 284, 285, 286, 288, 290, 291, 292, 298, 300, 302, 303, 304, 305, 306, 307, 308, 309, 310, 311, 1846, 1847, 1848, 1849, 1850, 1851, 1853, 1854, 1856, 1857, 1859, 1862, 1864, 1865, 1867, 1868, 1869, 1870; 252-265 for the protein of sequence SEQ ID No. 268; 255-268 for the protein of sequence SEQ ID No. 289; 267-280 for the protein of sequence SEQ ID No. 299; 252-265 for the protein of sequence SEQ ID No. 1858 |

-continued

| Peptide SEQ ID No. | Amino acid sequence | Position of the peptide in the CMY protein |
|---|---|---|
| SEQ ID No. 336 | YWPELTGK | 112-119 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 296, 297, 298, 300, 302, 303, 304, 305, 306, 307, 308, 309, 310, 311, 1846, 1847, 1848, 1849, 1850, 1851, 1853, 1854, 1855, 1856, 1857, 1859, 1862, 1864, 1865, 1866, 1867, 1868, 1869, 1870; 111-118 for the protein of sequence SEQ ID No. 268; 126-133 for the protein of sequence SEQ ID No. 299; 111-118 for the protein of sequence SEQ ID No. 1858 |
| SEQ ID No. 337 | AHYFNYGVANR | 62-72 for the proteins of SEQ No. 262, 263, 264, 293, 294, 301, 1844, 1845, 1860, 1861, 1863 |
| SEQ ID No. 338 | ANIGGVDDK | 261-269 for the proteins of SEQ No. 262, 263, 264, 293, 294, 301, 1844, 1845, 1860, 1861, 1863 |
| SEQ ID No. 339 | ESGSQVLFNK | 326-335 for the proteins of SEQ No. 262, 263, 264, 293, 294, 301, 1844, 1845, 1860, 1861, 1863 |
| SEQ ID No. 340 | GAMQLDDK | 105-112 for the proteins of SEQ No. 262, 263, 264, 293, 294, 301, 1844, 1845, 1860, 1861, 1863 |
| SEQ ID No. 341 | GIGIVMLANR | 353-362 for the proteins of SEQ No. 262, 263, 264, 293, 294, 301, 1844, 1845, 1860, 1861, 1863 |
| SEQ ID No. 342 | HAPWLK | 116-121 for the proteins of SEQ No. 262, 263, 264, 293, 294, 301, 1844, 1845, 1860, 1861, 1863 |
| SEQ ID No. 343 | IPGMAVAVLK | 49-58 for the proteins of SEQ No. 262, 263, 264, 293, 294, 301, 1844, 1845, 1860, 1861, 1863 |
| SEQ ID No. 344 | PVVDASIQPLLK | 34-45 for the proteins of SEQ No. 262, 263, 264, 293, 294, 301, 1844, 1845, 1860, 1861, 1863 |
| SEQ ID No. 345 | QAMASYAYGYSK | 218-229 for the proteins of SEQ No. 262, 263, 264, 293, 294, 301, 1844, 1845, 1860, 1861, 1863 |
| SEQ ID No. 346 | QWAPVYSPGSHR | 161-172 for the proteins of SEQ No. 262, 263, 264, 293, 294, 301, 1844, 1845, 1860, 1861, 1863 |
| SEQ ID No. 347 | QYSNPSIGLFGHLAASSLK | 173-191 for the proteins of SEQ No. 262, 263, 264, 293, 294, 301, 1844, 1845, 1860, 1861, 1863 |
| SEQ ID No. 348 | TGSTNGFGAYVAFVPAR | 336-352 for the proteins of SEQ No. 262, 263, 264, 293, 294, 301, 1844, 1845, 1860, 1861, 1863 |
| SEQ ID No. 349 | TLTATLGAYAVVK | 92-104 for the proteins of SEQ No. 262, 263, 264, 293, 294, 301, 1844, 1845, 1860, 1861, 1863 |
| SEQ ID No. 350 | VNPGMLADEAYGIK | 236-249 for the proteins of SEQ No. 262, 263, 264, 293, 294, 301, 1844, 1845, 1860, 1861, 1863 |
| SEQ ID No. 734 | PSGMSYEEAMTR | 185-196 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 296, 297, 298, 300, 302, 303, 304, 305, 306, 307, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 184-195 for the protein of sequence SEQ ID No. 268; 199-210 for the protein of sequence SEQ ID No. 299; 184-195 for the protein of sequence SEQ ID No. 1858 |
| SEQ ID No. 735 | PYYFTWGK | 58-65 for the proteins of SEQ No. 265, 266, 267, 269, 270, 271, 272, 273, 274, 275, 276, 277, 278, 279, 280, 281, 282, 283, 284, 285, 286, 287, 288, 289, 290, 291, 292, 295, 297, 298, 300, 302, 303, 304, 305, 306, 307, 308, 309, 310, 311, 1846, 1847, 1848, 1849, 1850, 1851, 1852, 1853, 1854, 1855, 1856, 1857, 1859, 1862, 1864, 1865, 1866, 1867, 1868, 1869, 1870; 57-64 for the protein of sequence SEQ ID No. 268; 72-79 for the protein of sequence SEQ ID No. 299; 57-64 for the protein of sequence SEQ ID No. 1858 |
| SEQ ID No. 1929 | AALLR | 149-153 for the proteins of SEQ No. 265, 282, 287, 297, 298, 1852, 1853, 1855 |

| Peptide SEQ ID No. | Amino acid sequence | Position of the peptide in the CMY protein |
|---|---|---|
| SEQ ID No. 1930 | ADSIINGNGSDSK | 300-312 for the proteins of SEQ No. 267, 1847 |
| SEQ ID No. 1931 | ADSIINGSDNK | 300-310 for the proteins of SEQ No. 275, 1849; 299-309 for the protein of sequence SEQ ID No. 268 |
| SEQ ID No. 1932 | AELLR | 149-153 for the protein of SEQ No. 288 |
| SEQ ID No. 1933 | ALQQAISLTHK | 270-280 for the proteins of SEQ No. 262, 293, 294, 1860, 1861 |
| SEQ ID No. 1934 | AVHVSPGQLDAEAYGVK | 228-244 for the proteins of SEQ No. 273, 297, 1855 |
| SEQ ID No. 1935 | DYACGYR | 218-224 for the protein of SEQ No. 281 |
| SEQ ID No. 1936 | DYALGYR | 218-224 for the protein of SEQ No. 306 |
| SEQ ID No. 1937 | EDKPIR | 230-235 for the proteins of SEQ No. 262, 263, 264, 293, 294, 301, 1844, 1845, 1860, 1861, 1863 |
| SEQ ID No. 1938 | EGKPVHASPGQLDAEAYGVK | 239-258 for the protein of SEQ No. 299 |
| SEQ ID No. 1939 | EGKPVHGSPGQLDAEAYGVK | 225-244 for the protein of SEQ No. 278 |
| SEQ ID No. 1940 | EGKPVHVSPEQLDAEAYGVK | 225-244 for the protein of SEQ No. 283 |
| SEQ ID No. 1941 | EGKPVHVSPGK | 225-235 for the protein of SEQ No. 269 |
| SEQ ID No. 1942 | EGKPVHVSPGQFDAEAYGVK | 225-244 for the protein of SEQ No. 291 |
| SEQ ID No. 1943 | EGKPVHVSPGQLDAEAYCVK | 225-244 for the proteins of SEQ No. 1856 |
| SEQ ID No. 1944 | EGKPVHVSPGQLDAEAYGVK | 225-244 for the proteins of SEQ No. 265, 266, 267, 270, 272, 275, 277, 279, 280, 281, 282, 284, 285, 286, 288, 290, 292, 295, 296, 298, 300, 302, 303, 304, 305, 306, 307, 308, 309, 310, 1846, 1847, 1848, 1849, 1850, 1851, 1854, 1857, 1859, 1862, 1864, 1865, 1866, 1867, 1868, 1869, 1870; 224-243 for the protein of sequence SEQ ID No. 268; 224-243 for the protein of sequence SEQ ID No. 1858 |
| SEQ ID No. 1945 | EGKPVHVSPGQLDAGAYGVK | 225-244 for the protein of SEQ No. 271 |
| SEQ ID No. 1946 | EGKPVHVSPGQLNAEAYGVK | 225-244 for the protein of SEQ No. 311 |
| SEQ ID No. 1947 | EGKPVHVSPGR | 225-235 for the protein of SEQ No. 276 |

-continued

| Peptide SEQ ID No. | Amino acid sequence | Position of the peptide in the CMY protein |
|---|---|---|
| SEQ ID No. 1948 | EGKPVHVTPGQLDAEAYGVK | 225-244 for the proteins of SEQ No. 287, 1852 |
| SEQ ID No. 1949 | EGKPVYVSPGQLDAEAYGVK | 225-244 for the protein of SEQ No. 274 |
| SEQ ID No. 1950 | ESGAGVSEQTLFEIGSVSK | 73-91 for the proteins of SEQ No. 263, 264, 301, 1844, 1845, 1863 |
| SEQ ID No. 1951 | ESGASVSEQTLFDIGSVSK | 73-91 for the proteins of SEQ No. 293, 294, 1860, 1861 |
| SEQ ID No. 1952 | ESGASVSEQTLFEIGSVSK | 73-91 for the protein of SEQ No. 262 |
| SEQ ID No. 1953 | FSDPVTK | 105-111 for the protein of SEQ No. 307 |
| SEQ ID No. 1954 | FYQNWQPQWAPGAK | 154-167 for the proteins of SEQ No. 265, 295, 296, 297, 1855 |
| SEQ ID No. 1955 | FYQNWQPQWTPGAK | 154-167 for the proteins of SEQ No. 266, 267, 269, 270, 271, 272, 273, 274, 275, 276, 277, 278, 279, 280, 281, 282, 283, 284, 285, 286, 287, 288, 289, 290, 291, 292, 298, 300, 302, 303, 304, 305, 306, 307, 308, 309, 310, 311, 1846, 1847, 1848, 1849, 1850, 1851, 1852, 1853, 1854, 1856, 1857, 1859, 1862, 1864, 1865, 1866, 1867, 1868, 1869, 1870; 153-166 for the protein of sequence SEQ ID No. 268; 168-181 for the protein of sequence SEQ ID No. 299; 153-166 for the protein of sequence SEQ ID No. 1858 |
| SEQ ID No. 1956 | IPDDVR | 141-146 for the proteins of SEQ No. 266, 267, 269, 270, 271, 273, 274, 275, 276, 278, 279, 281, 283, 284, 285, 286, 289, 290, 291, 292, 300, 302, 303, 304, 305, 306, 307, 308, 309, 310, 311, 1846, 1847, 1848, 1849, 1850, 1851, 1854, 1856, 1857, 1859, 1862, 1864, 1865, 1866, 1867, 1868, 1869, 1870; 155-160 for the protein of sequence SEQ ID No. 299; 140-145 for the protein of sequence SEQ ID No. 1858 |
| SEQ ID No. 1957 | LAHTWIK | 204-210 for the protein of SEQ No. 297 |
| SEQ ID No. 1958 | LAHTWITVPENEQK | 204-217 for the protein of SEQ No. 279 |
| SEQ ID No. 1959 | LAHTWITVPQSEQK | 204-217 for the proteins of SEQ No. 282, 288, 295, 296, 298, 1853 |
| SEQ ID No. 1960 | LDAEAYGVK | 236-244 for the proteins of SEQ No. 265, 266, 267, 269, 270, 272, 273, 274, 275, 276, 277, 278, 279, 280, 281, 282, 283, 284, 285, 286, 287, 288, 290, 292, 295, 296, 297, 298, 300, 302, 303, 304, 305, 306, 307, 308, 309, 310, 1846, 1847, 1848, 1849, 1850, 1851, 1852, 1853, 1854, 1855, 1857, 1859, 1862, 1864, 1865, 1866, 1867, 1868, 1869, 1870; 235-243 for the protein of sequence SEQ ID No. 268; 238-246 for the protein of sequence SEQ ID No. 289; 250-258 for the protein of sequence SEQ ID No. 299; 235-243 for the protein of sequence SEQ ID No. 1858 |
| SEQ ID No. 1961 | LLHLATYTAGGLPLK | 126-140 for the proteins of SEQ No. 1870 |
| SEQ ID No. 1962 | LLHLATYTAGGLPLQFPDDVR | 126-146 for the protein of SEQ No. 277 |

| Peptide SEQ ID No. | Amino acid sequence | Position of the peptide in the CMY protein |
|---|---|---|
| SEQ ID No. 1963 | LYANSSIGLFAALAVK | 169-184 for the protein of SEQ No. 285 |
| SEQ ID No. 1964 | LYANSSIGLFGALVVK | 169-184 for the protein of SEQ No. 288 |
| SEQ ID No. 1965 | LYANSSIGLFGELAVK | 169-184 for the proteins of SEQ No. 269, 275, 277, 305, 1849, 1866 |
| SEQ ID No. 1966 | LYANSSIGLFGTLAVK | 169-184 for the protein of SEQ No. 282 |
| SEQ ID No. 1967 | LYANSSIGLFSALAVK | 169-184 for the proteins of SEQ No. 1859 |
| SEQ ID No. 1968 | LYSNSSIGLFGALAVK | 169-184 for the proteins of SEQ No. 304, 310, 1865, 1869, 1870 |
| SEQ ID No. 1969 | NYAWGYR | 218-224 for the proteins of SEQ No. 288, 298, 1853 |
| SEQ ID No. 1970 | NYPIPAR | 363-369 for the proteins of SEQ No. 262, 293, 294, 1860, 1861 |
| SEQ ID No. 1971 | NYPNEAR | 363-369 for the proteins of SEQ No. 301, 1863 |
| SEQ ID No. 1972 | NYPNPVR | 363-369 for the proteins of SEQ No. 304, 308, 311, 1865, 1867 |
| SEQ ID No. 1973 | SICCALLLTASFSTFAAAK | 5-23 for the proteins of SEQ No. 288, 1853 |
| SEQ ID No. 1974 | SICCALLLTASFSTFAATK | 5-23 for the protein of SEQ No. 298 |
| SEQ ID No. 1975 | SLCCALLLTAPLSTFAAAK | 5-23 for the protein of SEQ No. 297 |
| SEQ ID No. 1976 | SLCCALLLTASFSTFASAK | 5-23 for the proteins of SEQ No. 265, 296 |
| SEQ ID No. 1977 | SLCCALLLTASLSTFAAAK | 5-23 for the proteins of SEQ No. 1855 |
| SEQ ID No. 1978 | SNVTDMAR | 245-252 for the proteins of SEQ No. 265, 287, 296, 1852 |
| SEQ ID No. 1979 | SYPNPIR | 363-369 for the protein of SEQ No. 295 |
| SEQ ID No. 1980 | TALLHFYQNWQPQWAPGAK | 149-167 for the proteins of SEQ No. 295, 296 |
| SEQ ID No. 1981 | TDSIINGSDSK | 300-310 for the proteins of SEQ No. 292, 1854 |

-continued

| Peptide SEQ ID No. | Amino acid sequence | Position of the peptide in the CMY protein |
|---|---|---|
| SEQ ID No. 1982 | TFIGVLGGDAIAR | 88-100 for the proteins of SEQ No. 1857 |
| SEQ ID No. 1983 | TFNGVLGGDCIAR | 88-100 for the protein of SEQ No. 279 |
| SEQ ID No. 1984 | TFNGVLGGEAIAR | 88-100 for the protein of SEQ No. 290 |
| SEQ ID No. 1985 | TGSTVGFGSYVAFVPEK | 336-352 for the proteins of SEQ No. 1870 |
| SEQ ID No. 1986 | TGYTGGFGSYVAFVPEK | 336-352 for the protein of SEQ No. 282 |
| SEQ ID No. 1987 | TLQQGIELAQSR | 267-278 for the proteins of SEQ No. 282, 288, 298, 1853 |
| SEQ ID No. 1988 | TSSADLLAFVK | 250-260 for the proteins of SEQ No. 262, 293, 294, 1860, 1861 |
| SEQ ID No. 1989 | TSSADLLR | 250-257 for the proteins of SEQ No. 263, 264, 301, 1844, 1845, 1863 |
| SEQ ID No. 1990 | TYYFTWGK | 58-65 for the protein of SEQ No. 296 |
| SEQ ID No. 1991 | VAALPAVEVNPPAPAVK | 311-327 for the proteins of SEQ No. 284, 1850 |
| SEQ ID No. 1992 | VAFAALPAVEVNPPAPAVK | 311-329 for the proteins of SEQ No. 266, 1846 |
| SEQ ID No. 1993 | VALAAIPAVEVNPPAPAVK | 311-329 for the protein of SEQ No. 295 |
| SEQ ID No. 1994 | VALAALHTVEVNPPAPAVK | 311-329 for the protein of SEQ No. 287 |
| SEQ ID No. 1995 | VALAALPAVEINPPAPAVK | 311-329 for the proteins of SEQ No. 309, 1868 |
| SEQ ID No. 1996 | VALAALPTVEVNPPAPAVK | 311-329 for the proteins of SEQ No. 1852 |
| SEQ ID No. 1997 | VAPAVEVNPPAPAVK | 311-325 for the proteins of SEQ No. 286, 1851 |
| SEQ ID No. 1998 | VEAYWR | 370-375 for the proteins of SEQ No. 270, 1848 |
| SEQ ID No. 1999 | VILEANPTAAPR | 314-325 for the proteins of SEQ No. 262, 263, 293, 301, 1844, 1860, 1863 |
| SEQ ID No. 2000 | VPQSEQK | 211-217 for the proteins of SEQ No. 282, 288, 295, 296, 297, 298, 1853 |

| Peptide SEQ ID No. | Amino acid sequence | Position of the peptide in the CMY protein |
|---|---|---|
| SEQ ID No. 2001 | VSLEANPTAAPR | 314-325 for the proteins of SEQ No. 264, 294, 1845, 1861 |
| SEQ ID No. 2002 | WIQVNMDASR | 253-262 for the proteins of SEQ No. 287, 1852 |
| SEQ ID No. 2003 | WVQANMDASR | 253-262 for the protein of SEQ No. 295 |
| SEQ ID No. 2004 | WVQVNMDASR | 253-262 for the proteins of SEQ No. 265, 273, 296, 297, 1855 |
| SEQ ID No. 2005 | YAAALLLTASFSTFAAAK | 5-22 for the proteins of SEQ No. 1858 |
| SEQ ID No. 2006 | YLPELTGK | 112-119 for the proteins of SEQ No. 1852 |
| SEQ ID No. 2007 | YWSELTGK | 112-119 for the protein of SEQ No. 295 |

The detection of a mechanism of resistance to cephalosporins induced by the expression of the CTX-M protein is characterised by the detection of at least one peptide belonging to the CTX-M protein and to its different sequence variants SEQ ID No. 351 to SEQ ID No. 445 and SEQ ID No. 1871 to SEQ ID No. 1908.

SEQ ID No. 351:
MMTQSIRRSMLTVMATLPLLFSSATLHAQTNSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWGVGDKTGSGDYGTTNDIA
VIWPANHAPLVLVTYFTQPEQKAESRRDVLAAAAKIVTHGF

SEQ ID No. 352:
MMRHRVKRMMLMTTACISLLLGSAPLYAQANDVQQKLAALEKSSGGRLGV
ALIDTADNAQTLYRADERFAMCSTSKVMAAAAVLKQSETQKKVLSQKVEI
KSSDLINYNPITEKHVNGTMTLAELSAAALQYSDNTAMNKLIAHLGGPDK
VTAFARAIGDNTFRLDRTEPTLNTAIPGDPRDTTTPLAMAQTLRNLTLGS
ALGETQRAQLVTWLKGNTTGAASIQAGLPTSWVVGDKTGSGDYGTTNDIA
VIWPEGRAPLILVTYFTQPEQKAESRRDVLAAAAKIVTDGY

SEQ ID No. 353:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTAGDKTGSGDYGTTNDIA
VIWPQGRAPLVLVTYFTQPQQNAESRRDVLASAARIIAEGL

SEQ ID No. 354:
MVKKSLRQFTLMATATVTLLLGSVPLYAQTVDVQQKLAELEQQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 355:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 356:
MVTKRMQRMMFAAAACIPLLLGSAPLYAQTSAVQQKLAALEKSSGGRLGV
ALIDTKDNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFAREIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 357:
MVKKSLRQFTLMATATVTLLLGSVPLYAQTADVQQKLAGLERQSGGRLGV
ALINTADNSQILYRADERFAMCSTSKVMAAAAVLKKSESEPNLLNQRVEI
KKSDLVNYNPIAEKHVNGTMSPAELSAAALQYSDNVAMNKLIAHVGGPAS
VTAFARQLGDETFRLDRTEPTLNTAIPGDPRDTTSPRAMAQTLRNLTLGK
ALGDSQRAQLVTVVMKGNTTGAASIQAGLPASWVVGDKTGSGDYGTTNDI
AVIWPKDRAPLILVTYFTQPQPKAESRRHVLAS

SEQ ID No. 358:
MVKKSLRQFTLMATAAVTLLLGSVPLYAQTADVQQKLAELERQSGGRLGV
ALINTADNSQILYRADERFAMCSTSKVMAAAAVLKKSESEPSLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDILASAAKIVTDGL

SEQ ID No. 359:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTAGDKTGSGGYGTTNDIA
VIWPQGRAPLVLVTYFTQPQQNAESRRDVLASAARIIAEGL

SEQ ID No. 360:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 361:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTESTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 362:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAKGL

SEQ ID No. 363:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 364:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 365:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTETTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 366:
MMRKSVRRAMLMTTACVSLLLASVPLCAQANDVQQKLAALEKSSGGRLGV
ALINTADNTQTLYRADERFAMCSTSKVMAVAAVLKQSETQKGLLSQRVEI
KPSDLINYNPIAEKHVNGTMTFGELSAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIQAGLPTSWVVGDKTGSGGYGTTNDIA
VIWPEGRAPLVLVTYFTQSEPKAESRRDVLAAAARIVTDGY

SEQ ID No. 367:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 368:
MMRKSVRRAMLMTTACVSLLLASVPLCAQANDVQQKLAALEKSSGGRLGV
ALINTADNTQTLYRADERFAMCSTSKVMAAAAVLKQSETQKGLLSQRVEI
KPSDLINYNPIAEKHVNGTMTFGELSAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIRAGLPTSWVVGDKTGSGDYGTTNDIA
VIWPEGRAPLVLVTYFTQSEPKAESRRDVLAAAARIVTDGY

SEQ ID No. 369:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGGYGTTNDIA
VIWPQGRAPLVLVTYFTQPQQNAESRRDVLASAARIIAEGL

SEQ ID No. 370:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYSPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 371:
MVKKSLRQFTLMATAAVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVDGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 372:
MVKKSLRQFTLMATAAVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVDGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 373:
MVKKSLRQFTLMATATVTLLLGSVPLYAQTDVQQKLAELEQQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSCDYGTTNDIA
VIWPKDRAPLILVTYFTQPQPKAESRRDVLASAAKIVTDGL

SEQ ID No. 374:
MVKKSLRQFTLMATATVTLLLGSVPLHAQTADVQQKLAELEQQSGGRLGV
ALINTADNSQILYRADERFAMCSTSKVMAAAAVLKKSESEPNLLNQRVEI
KKSDLVNYNPIAEKHVDGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 375:
MRHRVKRMMLMTTACISLLLGSAPLYAQANDVQQKLAALEKSSGGRLGVA
LIDTADNAQTLYRADERFAMCSTSKVMAAAAVLKQSETQKNVLSQKVEIK
SSDLINYNPIAEKHVNGTMTLAELSAAALQYSDNTAMNKLIAHLGGPDKV
TAFARAIGDDTFRLDRTEPTLNTAIPGDPRDTTTPLAMAQTLRHLTLGSA
LGETQRAQLVTWLKGNTTGAASIQAGLPTSWVVGDKTGSGDYGTTNDIAV
IWPEGRAPLILVTYFTQPEQKAESRRDVLAAAAKIVTDGY

SEQ ID No. 376:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAARIRAGLPTSWTVGDKTGSGDYGTTNDIA
VIWPQGRAPLVLVTYFTQPQQNAESRRDVLASAARIIAEGL

SEQ ID No. 377:
MVTKRVQRMMFAAAACIPLLLGSAPLYAQTSAVQQKLAALEKSSGRRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 378:
MVTKRVQRMMFAAAACIPLLLGSAPLYAQTNAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 379:
MVTKRVQRMMFAAAACIPLLLGSAPLYAQTSAVQQKLAALEKSSGRRLGV
PLIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 380:
MVTKRVQRMMFAAAACIPLLLGSAPLYAQTSAVQQKLAALEKSSGGRLGV
PLIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 381:
MVTKRVQRMMFAAAACIPLLLGSAPLYAQTNAVQQKLAALEKSSGGRLGV
PLIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 382:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDGTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 383:
MMRKSVRRAMLMTTACVSLLLASVPLCAQANDVQQKLAALEKSSGGRLGV
ALINTADNTQTLYRADERFAMCSTSKVMAAAAVLKQSETQKGLLSQRVEI
KPSDLINYNPIAEKHVNGTMTFGELSAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIQAGLPTSWVVGDKTGSGDYGTTNDIA
VIWPEGRAPLVLVTYFTQSEPKAESRRDVLAAAARIVTDGY

SEQ ID No. 384:
MMRKSVRRAMLMTTACVSLLLASVPLCAQANDVQQKLAALEKSSGGRLGV
ALINTADNTQTLYRADERFAMCSTSKVMAAAAVLKQSETQKGLLSQRVEI
KPSDLVNYNPIAEKHVNGTMTFGELIAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIQAGLPTSWVVGDKTGSGDYGTTNDIA
VIWPEGRAPLVLVTYFTQSEPKAESRRDVLAAAARIVTDGY

SEQ ID No. 385:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTETTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 386:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGGYGTTNDIA
VIWPENHAPLVLVTYFTQPEQKAERRRDILAAAAKIVTHGF

SEQ ID No. 387:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTAGDKTGSGDYGTTNDIA
VIWPQGRAPLVLVTYFTQPQQNAESRRDVLASAARIIAEGL

SEQ ID No. 388:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTESTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 389:
MVKKSLRQFTLMATATVTLLLGSVPLYAQTADVQQKLAELERQSGGRLGV
ALINTADNSQILYRADERFPMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 390:
MVKKSLRQFTLMATATVTLLLGSVPLYAQTVDVQQKLAELEQQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVIYFTQPQPKAESRRDVLASAAKIVTDGL

SEQ ID No. 391:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEQTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 392:
MMTQSIRRSMLTVMATLPLLFSSATLHAQANSVQQQLEALEKSSGGRLGV
ALINTADNSQILYRADERFAMCSTSKVMAAAAVLKQSESDKLLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 393:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 394:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 395:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVDGTMSLAELSAAALQYSDNVAMNKLISHVGGPAS
VTAFARQLGDETFRLDRTETTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 396:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVDGTMSLAELSAAALQYSDNVAMNKLISHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 397:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAENRRDILAAAAKIVTHGF

SEQ ID No. 398:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 399:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 400:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTESTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 401:
MVKKSLRQFTLMATATVTLLLGNVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 402:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYSPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 403:
MVTKRVQRMMFAAAACIPLLLGSAPLYAQTSAVQQKLAALEKSSGGRLGV
ALIDTADNTQVLYRGDERFPMCSTSKVMAAAAVLEQSETQKQLLNQPVEI
QPADLVNYNPIAEKHVNGTMTLAELSAAALQYSDHTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 404:
MVKKSLRQFTLMATATVTLLLGSVPLHAQTVDVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDDTFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 405:
MVKKSLRQFTLMATATVTLLLGSVPLYAQTVDVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 406:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPNAESRRDVLASAAKIVTNGL

SEQ ID No. 407:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTELTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 408:
MVTKRVQRMMFAAAACIPLLLGSAPLYAQTSAVQQKLAALEKSSGGRLGV
ALIDTADNTHVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 409:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVAWLKGNTTGAASIRAGLPTSWTVGDKTGSGDYGTTNDIA
VIWPQGRAPLVLVTYFTQPQQNAESRRDVLASAARIIAEGL

SEQ ID No. 410:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTPAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 411:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPFAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 412:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRHDVLASAAKIVTDGL

SEQ ID No. 413:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 414:
MMRKSVRRAMLMTTACVSLLLASVPLCAQANDVQQKLAALEKSSGGRLGV
ALIDTADNTQTLYRADERFAMCSTSKVMAVAAVLKQSETQKGLLSQRVEI
KPSDLINYNPIAEKHVNGTMTFGELSAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIQAGLPTSWVVGDKTGSGDYGTTNDIA
VIWPEGRAPLVLVTYFTQSEPKAESRRDVLAAAARIVTDGY

SEQ ID No. 415:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTETTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 416:
MMTQSIRRSMLTVMATLSLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 417:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSCGYGTTNDIA
VIWPKDRAPLILVTYFTQPQPKAESRRDVLASAAKIVTDGL

SEQ ID No. 418:
MMRKSVRRAMLMTTACVSLLLASVPLCAQANDVQQKLAALEKSSGGRLGV
ALINTADNTQTLYRADERFAMCSTSKVMAVAAVLKQSETQKGLLSQRVEI
KPSDLINYNPIAEKHVNGTMTFGELSAAALQYSDNTAMNKLIAHLGGPDK
VTAFARTIGDDTFRLDRTEPTLNTAIPGDPRDTTTPLAMAQSLRNLTLGN
ALGDTQRAQLVMWLKGNTTGAASIQAGLPTSWVVGDKTGSGDYGTTNDIA
VIWPEGRAPLVLVTYFTQSEPKAESRRDVLAAAARIVTDGY

SEQ ID No. 419:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRTQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 420:
MMRKSVRRAMLMTTACVSLLLASVPLCAQANDVQQKLAALEKSSGGRLGV
ALINTADNTQTLYRADERFAMCSTSKVMAAAAVLKQSETQKGLLSQRVEI
KPSDLINYNPIAEKHVNGTMTLGELSAAALQYSDNTAMNKLIAHLGGPDK
VTAFARTIGDDTFRLDRTEPTLNTAIPGDPRDTTTPLAMAQALRNLTLGN
ALGDTQRAQLVMWLKGNTTGAASIQAGLPTSWVVGDKTGSGDYGTTNDIA
VIWPEGRAPLVLVTYFTQSEPKAESRRDVLAAAARIVTDGY

SEQ ID No. 421:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTESTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 422:
MMTQSIGRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 423:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGGYGTTNDIA
VIWPQGRAPLVLVTYFTQPQQNAESRRDVLASAARIIAEGL

SEQ ID No. 424:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAERRRDILAAAAKIVTHGF

SEQ ID No. 425:
MVTKRVQRMMSAAAACIPLLLGSPTLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTARAGADVASLRWVMR
WAKPSGAVGDVAQRQYDRAAGIRAGLPTSWTVGDKTGSGDYGTTNDIAVI
WPQGRAPLVLVTYFTQPQQNAESRRDVLASAARIIAEGL

SEQ ID No. 426:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVDGTMSLAELSAAALQYSDNVAMNKLISHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 427:
MRHRVKRMMLMTTACISLLLGSAPLYAQANDVQQKLAALEKSSGGRLGVA
LIDTADNAQTLYRADERFAMCSTSKVMAAAAVLKQSETQKNVLSQKVEIK
SSDLINYNPIAEKHVNGTMTLAELSAAALQYSDNTAMNKLIAHLGGPDKV
TAFARAIGDDTFRLDRTEPTLNTAIPGDPRDTTTPLAMAQTLRHLTLGSA
LGETQRAQLVTWLKGNTTGAASIQAGLPTSWVVGDKTGSGDYGTTNDIAV
IWPEGRAPLILVTYFTQPEQKAENRRDVLAAAAKIVTDGY

SEQ ID No. 428:
MVKKSLRQFTLMATATVTLLLGSVPLYAQTADVQQKLAELERQSGGRLGV
ALINTADNSQILYRADERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPASWVGDKTGSGGYGTTNDIA
VIWPKDRAPLILVTYFTQPQPKAESRRDVLASAAKIVTDGL

SEQ ID No. 429:
MMTQSIRRSMLTVMATLPLLFSSATLHAQANSVQQQLEALEKSSGGRLGV
ALINTADNSQILYLADERFAMCSTSKVMAAAAVLKQSESDKHLLNQRVEI
KASDLVNYNPIAEKHVNGTMTLAELGAGALQYSDNTAMNKLIAHLGGPDK
VTAFARSLGDETFRLDRTEPTLNSAIPGDPRDTTTPLAMAQTLKNLTLGK
ALAETQRAQLVTWLKGNTTGSASIRAGLPKCWVVGDKTGSGDYGTTNDIA
VIWPENHAPLVLVTYFTQPEQKAESRRDVLAAAAKIVTHGF

SEQ ID No. 430:
MMTQSIRRSMLTVMATLPLLFSSATLHAQANSVQQQLEALEKSSGGRLGV
ALINTADNSQILYVADERFAMCSTSKVMAAAAVLKQSESDKHLLNQRVEI
RASDLVNYNPIAEKHVNGTMTLAQLGAGALQYSDNTAMNKLIAHLGGPDK
VTAFARSLGDETFRLDRTEPTLNSAIPGDPRDTTTPLAMAQTLKNLTLGK
ALAETQRAQLVTWLKGNTTGSASIRAGLPKSWGVGDKTGSGDYGTTNDIA
VIWPENHAPLVLVTYFTQPEQKAESRRDVLAAAAKIVTHGF

SEQ ID No. 431:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVDGTMSLAELSAAALQYSDNVAMNKLISHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 432:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 433:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 434:
MMTQSIRRSMLTVMATLPLLFSSATLHAQANSVQQQLEALEKSSGGRLGV
AQINTADNSQILYVADERFAMCSTSKVMAAAAVLKQSESDKHLLNQRVEI
RASDLVNYNPIAEKHVNGTMTLAELGAGALQYSDNTAMNKLIAHLGGPDK
VTAFARSLGDETFRLDRTEPTLNSAIPGDPRDTTTPLAMAQTLKNLTLGK
ALAETQRAQLVTWLKGNTTGSASIRAGMPKSWGVGDKTGSGDYGTTNDIA
VIWPENHAPLVLVTYFTQPEQKAESRRDILAAAAKIVTHGF

SEQ ID No. 435:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDFLAAAAKIVTHGF

SEQ ID No. 436:
MVTKRVQRMMFAGGAGIPLLLGSAPFYAQTSAGQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 437:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 438:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVDGTMSLAELSAAALQYSDNVAMNKLISHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 439:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDESFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAESRRDILAAAAKIVTHGF

SEQ ID No. 440:
MVKKSLRQFTLMATAAVTLLLGSVPLYAQTADVQQKLAELERQSGGRLGV
ALINTADNSQILYRADERFAMCSTSKVMAAAAVLKKSESEPSLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDILASAAKIVTDGL

SEQ ID No. 441:
MVKKSLRQFTLMATAAVTLLLGSVPLYAQTADVQQKLAELERQSGGRLGV
ALINTADNSQILYRADERFAMCSTSKVMAVAAVLKKSESEPSLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDILASAAKIVTDGL

SEQ ID No. 442:
MMTQSIRRSMLTVMATLPLLFSSATLHAQTNSVQQQLKALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIQAGLPKSWVVGDKTGSGDYGTTNDIA
IIWPENHAPLVLVTYFTQPEQKAESRRDVLAAAAKIVTRGF

SEQ ID No. 443:
MMRKSVRRAILMTTACVSLLLASVPLYAQANDIQQKLAALEKSSGGRLGV
ALINTADNTQTLYRADERFAMCSTSKVMAAAAVLKQSETQKDLLSQRVEI
KSSDLINYNPIAEKHVNGTMTLGELSAAALQYSDNTAMNKLIAHLGGPGK
VTAFARVIGDDTFRLDRTEPTLNTAIPGDPRDTTTPLAMAQTLRNLTLGN
ALGDTQRAQLVTWLKGNTTGAASIQAGLPTSWVVGDKTGSGDYGTTNDIA
VIWPEGRAPLVLVTYFTQPEPKAESRRDVLAAAARIVTDGY

SEQ ID No. 444:
MMTQSIRRSMLTVMATLPLLFSSATLHAQTNSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWGVGDKTGSGDYGTTNDIA
VIWPENHAPLVLVTYFTQPEQKAESRRDVLAAAAKIVTHGF

SEQ ID No. 445:
MMTQSIRRSMLTVMATLPLLFSSATLHAQTNSVQQQLEALEKSSGGRLGV
ALINTADNSQILYRADERFAMCSTSKVMAAAALLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIQAGLPKSWVVGDKTGSGDYGTTNDIA
VIWPENHAPLVLVTYFTQPEQKAESRRDVLAAAAKIVTHGF

SEQ ID No. 1871:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1872:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTESTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1873:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAKGL

SEQ ID No. 1874:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 1875:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTNGL

SEQ ID No. 1876:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 1877:
MRHRVKRMMLMTTACISLLLGSAPLYAQANDVQQKLAALEKSSGGRLGVA
LIDTADNAQTLYRADERFAMCSTSKVMAAAAVLKQSETQKNVLSQKVEIK
SSDLINYNPIAEKHVNGTMTLAELSAAALQYSDNTAMNKLIAHLGGPDKV
TAFARAIGDDTFRLDRTEPTLNTAIPGDPRDTTTPLAMAQTLRHLTLGSA
LGETQRAQLVTWLKGNTTGAASIQAGLPTSWVVGDKTGSGDYGTTNDIAV
IWPEGRAPLILVTYFTQPEQKAESRRDVLAAAAKIVTDGY

SEQ ID No. 1878:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 1879:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVDGTMSLAELSAAALQYSDNVAMNKLISHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGDYGTTNDIA
VIWPKDRAPLILVTYFTQPQPKAESRRDVLASAAKIVTDGL

SEQ ID No. 1880:
MMTQSIRRSMLTVMATLPLLFSSATLHAQANSVQQQLEALEKSSGGRLGV
ALINTADNSQILYRADERFAMCSTSKVMAAAAVLKQSESDKHLLNQRVEI
KKSDLVNYNPIAEKHVNGTMTLAELGAAALQYSDNTAMNKLIAHLGGPDK
VTAFARSLGDETFRLDRTEPTLNTAIPGDPRDTTTPLAMAQTLKNLTLGK
ALAETQRAQLVTWLKGNTTGSASIRAGLPKSWVVGDKTGSGDYGTTNDIA
VIWPENHAPLVLVTYFTQPEQKAENRRDILAAAAKIVTHGF

SEQ ID No. 1881:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 1882:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 1883:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPNAESRRDVLASAAKIVTNGL

SEQ ID No. 1884:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRHDVLASAAKIVTDGL

SEQ ID No. 1885:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1886:
MVKKSLRQFTLMATATVTLLLGSVPLYAQTADVQQKLAELERQSGGRLGV
ALINTADNSQILYRADERFAMCSTSKAMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 1887:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTESTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAERRRDVLASAARIIAEGL

SEQ ID No. 1888:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTQNTAIPGDPRDTTTPRAMAQTLRQLTLGH
ALGETQRAQLVTWLKGNTTGAASIRAGLPTSWTVGDKTGSGGYGTTNDIA
VIWPQGRAPLVLVTYFTQPQQNAESRRDVLASAARIIAEGL

SEQ ID No. 1889:
MVKKSLRQFTLMATATVTLLLGSVPLYAQTADVQQKLAELERQSGGRLGV
ALINTADNSQILYRADERFAMCSTSKVMAAAAVLKKSESEPNLLNQRVEI
KKSDLVNYNPIAEKHVNGTMSLAELIAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTDGL

SEQ ID No. 1890:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQREQLVTWLKGNTTGAASIRAGLPTSWTVGDKTGSGGYGTTNDIA
VIWPQGRAPLVLVTYFTQPQQNAESRRDVLASAARIIAEGL

SEQ ID No. 1891:
MVTKRVQRMMFAAAACIPLLLGSAPLYAQTSAVQQKLAALEKSSGGRLGV
ALIDTADNTQVLYRGDERFPMCSTSKVMAVAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQREQLVTWLKGNTTGAASIRAGLPTSWTVGDKTGSGGYGTTNDIA
VIWPQGRAPLVLVTYFTQPQQNAESRRDVLASAARIIAEGL

SEQ ID No. 1892:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAENRRDVLASAARIIAEGL

SEQ ID No. 1893:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDRTGSGDYGTTNDIA
VIWPQGRAPLVLVTYFTQPQQNAESRHDVLASAARIIAEG

SEQ ID No. 1894:
MVKKSLRQFTLMATATVTLLLGSVPLYAQTADVQQKLAELERQSGGRLGV
ALINTADNSQILYRADERFAMCSTSKVMAVAAVLKKSESEPNLLNQRVEI
KKSDLVNYNPIAEKHVNGTMSLAELSAAALQYSDNVAMNKLIAHVGGPAS
VTAFARQLGDETFRLDRTEPTLNTAIPGDPRDTTSPRAMAQTLRNLTLGK
ALGDSQRAQLVTWMKGNTTGAASIQAGLPASWVVGDKTGSGGYGTTNDIA
VIWPKDRAPLILVTYFTQPQPKAESRRDVLASAAKIVTNGL

SEQ ID No. 1895:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEEHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGNL

SEQ ID No. 1896:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELSAAALQYSDNTAMNKLIAQLGGQGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1897:
VKKSLRQFTLMATATVTLLLGSVPLYAQTADVQQKLAELERQSGGRLGVA
LINTADNSQILYRADERFAMCSTSKVMAAAAVLKKSESEPNLLNQRVEIK
KSDLVNYNPIAEKHVNGTMSLAELSAAALQYSDNVAMNKLIAHVGGPASV
TAFARQLGDETFRLDRTEPTLNTAIPGDPRDTTSPRAMAQTLRNLTLGKA
LGDSQRAQLVTWMKGNTTGAASIQAGLPASWVVGDRTGSGGYGTTNDIAV
IWPKDRAPLILVTYFTQPQPKAESRRDVLASAAKIVT

SEQ ID No. 1898:
VKKSLRQFTLMATATVTLLLGSVPLYAQTADVQQKLAELERQSGGRLGVA
LINTADNSQILYRADERFAMCSTSKVMAAAAVLKKSESEPNLLNQRAEIK
KSDLVNYNPIAEKHVNGTMSLAELSAAALQYSDNVAMNKLIAHVGGPASV
TAFARQLGDETFRLDRTEPTLNTAIPGDPRDTTSPRAMAQTLRNLTLGKA
LGDSQRAQLVTWMKGNTTGAASIQAGLPASWVVGDKTGSGGYGTTNDIAV
IWPKDRAPLILVTYFTQPQPKAESRRDVLASAAKIVT

SEQ ID No. 1899:
MVTKRVQRMMFAAAACIPLLLGSAPLYAQTSAVQQKLAALEKSSGGRLGV
ALIDTADNTQVLYRGDERFPMCSTSKVMAAAAVLKQSETQKQLLNQPVEI
KPADLVNYNPIAEKHVNGTMTLAELGAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1900:
MVTKRVQRMMFAAAACIPLLLGSAPLYAQTSAVQQKLAALEKSSGGRLGV
ALIDTADNTQVLYRGDERFPMCSTSKVMAAAAVLKRSETQKQLLNQPVEI
KPADLVNYNPIAEKHVNGTMTLAELSAAALQYSDNTAMNKLIAQLGGPGG
VTAFARAIGDETFRLDRTEPTLNTAIPGDPRDTTTPRAMAQTLRQLTLGH
ALGETQRAQLVTWLKGNTTGAASIRAGLPTSWTVGDKTGSGDYGTTNDIA
VIWPQGRAPLVLVTYFTQPQQNAESRRDVLASAARIIAEGL

SEQ ID No. 1901:
VKKSLRQFTLMATATVTLLLGSVPLYAQTADVQQKLAELERQSGGRLGVA
LINTADNSRILYRADERFAMCSTSKVMAAAAVLKKSESEPNLLNQRVEIK
KSDLVNYNPIAEKHVNGTMSLAELSAAALQYSDNVAMNKLIAHVGGPASV
TAFARQLGDETFRLDRTEPTLNTAIPGDPRDTTSPRAMAQTLRNLTLGKA
LGDSQRAQLVTWMKGNTTGAASIQAGLPASWVVGDKTGSGGYGTTNDIAV
IWPKDRAPLILVTYFTQPQPKAESRRDVLASAAKIVTK

SEQ ID No. 1902:
MMTQSIRRSMLTVMATLPLLFSSATLHAQANSVQQQLEALEKSSGGRLGV

ALINTADNSQILYRADERFAMCSTSKVMAAAAVLKQSESDKHLLNQRVEI

KKSDLVNYNPIAEKHVNGTMTLAELGAAALQYSDNTAMNKLIAHLGGPDK

VTAFARSLGDETFRLDRTEPTLNTAIPGDPRDTTTPLAMAQTLKNLTLGK

ALAETQRAQLVTWLKGNTTGSASIRAGLPKSWVVGDKTGSGDYGTTNDIA

VIWPENHAPLVLVTYFTQPEQKAERRRDILAAAAKIVTHGF

SEQ ID No. 1903:
MRHRVKRMMLMTTACISLLLGSAPLYAQANDVQQKLAALEKSSGGRLGVA

LIDTADNAQTLYRADERFAMCSTSKVMAAAAVLKQSETQKNVLSQKVEIK

SSDLINYNPIAEKHVNGTMTLAELSAAALQYSDNTAMNKLIAHLGGPDKV

TAFARAIGDDTFRLDRTEPTLNTAIPGDPRDTTTPLAMAQTLRHLTLGSA

LGETQRAQLVTWLKGNTTGAASIQAGLPTSWVVGDKTGSGDYGTTNDIAV

IWPEGRAPLILVTYFTQPEQKAENRRDVLAAAAKIVTDGY

SEQ ID No. 1904:
MVKKSLRQFTLMATATVTLLLGSVPLYAQTADVQQKLAELERQSGGRLGV

ALINTADNSQILYRADERFAMCSTSKVMAVAAVLKKSESEPNLLNQRVEI

KKSDLVNYNPIAEKHVDGTMSLAELSAAALQYSDNVAMNKLISHVGGPAS

VTAFARQLGDETFRLDRTEPTLNTAIPGDPRDTTSPRAMAQTLRNLTLGK

ALGDSQRAQLVTWMKGNTTGAASIQAGLPASWVVGDKTGSGDYGTTNDIA

VIWPKDRAPLILVTYFTQPQPKAESRRDVLASAAKIVTNGL

SEQ ID No. 1905:
MMTQSIRRSMLTVMATLPLLFSSATLHAQANSVQQQLEALEKSSGGRLGV

ALINTADNSQILYRADERFAMCSTSKVMAAAAVLKQSESDKHLLNQRVEI

KKSDLVNYNPIAEKHVNGTMTLAELGAAALQYSDNTAMNKLIAHLGGPDK

VTAFARSLGDETFRLDRTEPTLNTAIPGDPRDTTTPLAMAQTLKNLTLGK

ALAETQRAQLVTWLKGNTTGSASIRAGLPKSWVVGDKTGSGDYGTTNDIA

VIWPENHAPLVLVTYFTQPEQKAESRRDILAAAAKIVTHGF

SEQ ID No. 1906:
MVKKSLRQFTLMATATVTLLLGSVPLYAQTADVQQKLAELERQSGGRLGV

ALINTADNSQILYRADERFAMCSTSKVMAAAAVLKKSESEPNLLNQRVEI

KKSDLVNYNPIAEKHVNGTMSLAELSAAALQYSDNVAMNKLIAHVGGPAS

VTAFARQLGDETFRLDRTEPTLNTAIPGDPRDTTSPRAMAQTLRNLTLGK

ALGDSQRAQLVTWMKGNTTGAASIQAGLPASWVVGDKTGSGDYGTTNDIA

VIWPKDRAPLILVTYFTQPQPKAESRRDVLASAAKIVTDGL

SEQ ID No. 1907:
MMTQSIRRSMLTVMATLPLLFSSATLHAQANSVQQQLEALEKSSGGRLGV

ALINTADNSQILYRADERFAMCSTSKVMAAAAVLKQSESDKHLLNQRVEI

KKSDLVNYNPIAEKHVNGTMTLAELGAAALQYSDNTAMNKLIAHLGGPDK

VTAFARSLGDETFRLDRTEPTLNTAIPGDPRDTTTPLAMAQTLKNLTLGK

ALAETQRAQLVTWLKGNTTGSASIRAGLPKSWVVGDKTGSGDYGTTNDIA

VIWPENHAPLVLVTYFTQPEQKAESRRDFLAAAAKIVTHGF

SEQ ID No. 1908:
MVKKSLRQFTLMATATVTLLLGSVPLYAQTADVQQKLAELERQSGGRLGV

ALINTADNSQILYRADERFAMCSTSKVMAAAAVLKKSESEPNLLNQRVEI

KKSDLVNYNPIAEKHVNGTMSLAELSAAALQYSDNVAMNKLIAHVGGPAS

VTAFARQLGDETFRLDRTEPTLNTAIPGDPRDTTSPRAMAQTLRNLTLGK

ALGDSQRAQLVTWMKGNTTGAASIQAGLPASWVVGDKTGSGGYGTTNDIA

VIWPKDRAPLILVTYFTQPQPKAESRRDVLASAAKIVTNGL said peptides being chosen, preferably, from the peptides of sequence SEQ ID No. 446 to SEQ ID 495 and SEQ ID No. 2008 to SEQ ID No. 2092 as defined hereafter:

| Peptide SEQ ID No. | Amino acid sequence | Position of the peptide in the CTX-M protein | Clinical interest |
|---|---|---|---|
| SEQ ID No. 446 | AGLPK | 226-230 for the proteins of SEQ No. 351, 386, 392, 397, 415, 416, 419, 422, 424, 429, 430, 432, 435, 439, 442, 444, 445, 1881, 1903, 1906, 1908 | 2be |
| SEQ ID No. 447 | AGLPTSWTVGDK | 226-237 for the proteins of SEQ No. 355, 356, 360, 361, 362, 367, 369, 376, 377, 378, 379, 380, 381, 398, 402, 403, 407, 408, 409, 410, 411, 413, 421, 423, 436, 1872, 1873, 1874, 1877, 1882, 1886, 1888, 1889, 1891, 1892, 1893, 1896, 1897, 1900, 1901; 224-235 for the protein of sequence SEQ ID No. 425 | 2be |
| SEQ ID No. 448 | AIGDETFR | 157-164 for the proteins of SEQ No. 353, 355, 359, 360, 361, 362, 367, 369, 376, 377, 378, 379, 380, 381, 387, 398, 402, 403, 407, 408, 409, 410, 411, 413, 421, 423, 425, 428, 436, 1872, 1873, 1874, 1877, 1882, 1886, 1888, 1889, 1891, 1892, 1893, 1894, 1896, 1897, 1900, 1901 | 2be |
| SEQ ID No. 449 | ALAETQR | 201-207 for the proteins of SEQ No. 351, 386, 392, 397, 415, 416, 419, 422, 424, 429, 430, 432, 434, 435, 439, 442, 444, 445, 1881, 1903, 1906, 1908 | 2be |
| SEQ ID No. 450 | ALGDSQR | 201-207 for the proteins of SEQ No. 354, 357, 358, 363, 364, 365, 370, 371, 372, 373, 374, 382, 385, 388, 389, 390, 391, 393, 394, 395, 396, 399, 400, 401, 404, 405, 406, 412, 417, 426, 431, 433, 437, 438, 440, 441, 1875, 1876, 1879, 1880, 1883, 1884, 1885, 1887, 1890, 1895, | 2be |

-continued

| Peptide SEQ ID No. | Amino acid sequence | Position of the peptide in the CTX-M protein | Clinical interest |
|---|---|---|---|
| | | 1905, 1907, 1909; 200-206 for the protein of sequence SEQ ID No. 1898; 200-206 for the protein of sequence SEQ ID No. 1899; 200-206 for the protein of sequence SEQ ID No. 1902 | |
| SEQ ID No. 451 | AMAQTLR | 188-194 for the proteins of SEQ No. 352, 353, 354, 355, 356, 357, 358, 359, 360, 361, 362, 363, 364, 365, 367, 369, 370, 371, 372, 373, 374, 376, 377, 378, 379, 380, 381, 382, 385, 387, 388, 389, 390, 391, 393, 394, 395, 396, 398, 399, 400, 401, 402, 403, 404, 405, 406, 407, 408, 409, 410, 411, 412, 413, 417, 421, 423, 426, 428, 431, 433, 436, 437, 438, 440, 441, 443, 1872, 1873, 1874, 1875, 1876, 1877, 1879, 1880, 1882, 1883, 1884, 1885, 1886, 1887, 1888, 1889, 1890, 1891, 1892, 1893, 1894, 1895, 1896, 1897, 1900, 1901, 1905, 1907, 1909; 187-193 for the protein of sequence SEQ ID No. 375; 187-193 for the protein of sequence SEQ ID No. 427; 187-193 for the protein of sequence SEQ ID No. 1878; 187-193 for the protein of sequence SEQ ID No. 1898; 187-193 for the protein of sequence SEQ ID No. 1899; 187-193 for the protein of sequence SEQ ID No. 1902; 187-193 for the protein of sequence SEQ ID No. 1904 | 2be |
| SEQ ID No. 452 | APLILVTYFTQPQPK | 258-272 for the proteins of SEQ No. 354, 357, 358, 363, 364, 365, 370, 371, 372, 373, 374, 382, 385, 388, 389, 391, 393, 394, 395, 396, 399, 400, 401, 404, 405, 412, 417, 426, 428, 431, 433, 437, 438, 440, 441, 1875, 1876, 1879, 1880, 1883, 1885, 1887, 1890, 1895, 1905, 1907, 1909; 257-271 for the protein of sequence SEQ ID No. 1898; 257-271 for the protein of sequence SEQ ID No. 1899; 257-271 for the protein of sequence SEQ ID No. 1902 | 2be |
| SEQ ID No. 453 | APLVLVTYFTQPQQNAESR | 258-276 for the proteins of SEQ No. 353, 355, 356, 359, 360, 361, 362, 369, 376, 377, 378, 379, 380, 381, 387, 402, 403, 407, 408, 409, 410, 411, 413, 423, 436, 1872, 1873, 1874, 1886, 1889, 1891, 1892, 1894, 1896, 1897, 1900, 1901; 256-274 for the protein of sequence SEQ ID No. 425 | 2be |
| SEQ ID No. 454 | AQLVTWLK | 208-215 for the proteins of SEQ No. 351, 352, 353, 355, 356, 359, 360, 361, 362, 367, 369, 376, 377, 378, 379, 380, 381, 386, 387, 392, 397, 398, 402, 403, 407, 408, 410, 411, 413, 415, 416, 421, 422, 423, 424, 428, 429, 430, 432, 434, 435, 436, 439, 442, 443, 444, 445, 1872, 1873, 1874, 1877, 1881, 1882, 1886, 1888, 1889, 1893, 1894, 1896, 1897, 1900, 1901, 1903, 1906, 1908; 207-214 for the protein of SEQ ID No. 375; 207-214 for the protein of sequence SEQ ID No. 427; 207-214 for the protein of sequence SEQ ID No. 1878; 207-214 for the protein of sequence SEQ ID No. 1904 | 2be |
| SEQ ID No. 455 | AQLVTWMK | 208-215 for the proteins of SEQ No. 354, 357, 358, 363, 364, 365, 370, 371, 372, 373, 374, 382, 385, 388, 389, 390, 391, 393, 394, 395, 396, 399, 400, 401, 404, 405, 406, 412, 417, 426, 431, 433, 437, 438, 440, 441, 1875, 1876, 1879, 1880, 1883, 1884, 1885, 1887, 1890, 1895, 1905, 1907, 1909; 207-214 for the protein of sequence SEQ ID No. 1898; 207-214 for the protein of sequence SEQ ID No. 1899; 207-214 for the protein of sequence SEQ ID No. 1902 | 2be |
| SEQ ID No. 456 | DILAAAAK | 278-285 for the proteins of SEQ No. 386, 392, 397, 415, 416, 419, 422, 424, 432, 434, 439, 1881, 1903, 1906 | 2be |
| SEQ ID No. 457 | DTTSPR | 182-187 for the proteins of SEQ No. 354, 357, 358, 363, 364, 365, 370, 371, 372, 373, 374, 382, 385, 388, 389, 390, 391, 393, 394, 395, 396, 399, 400, 401, 405, 406, 412, 417, 426, 431, 433, 437, 438, 440, 441, 1875, 1876, 1879, 1880, 1883, 1884, 1885, 1887, 1890, 1895, 1905, 1907, 1909; 181-186 for the protein of sequence SEQ ID No. 1898; 181-186 for the protein of sequence SEQ ID No. 1899; 181-186 for the protein of sequence SEQ ID No. 1902 | 2be |

-continued

| Peptide SEQ ID No. | Amino acid sequence | Position of the peptide in the CTX-M protein | Clinical interest |
|---|---|---|---|
| SEQ ID No. 458 | DTTTPLAMAQTLK | 182-194 for the proteins of SEQ No. 351, 386, 392, 397, 415, 416, 419, 422, 424, 429, 430, 432, 434, 435, 439, 442, 444, 445, 1881, 1903, 1906, 1908 | 2be |
| SEQ ID No. 459 | DTTTPR | 182-187 for the proteins of SEQ No. 353, 355, 356, 359, 360, 361, 362, 367, 369, 376, 377, 378, 379, 380, 381, 387, 398, 402, 403, 407, 408, 409, 410, 411, 413, 421, 423, 428, 436, 1872, 1873, 1874, 1877, 1882, 1886, 1888, 1889, 1891, 1892, 1893, 1894, 1896, 1897, 1900, 1901 | 2be |
| SEQ ID No. 460 | DVLAAAAK | 277-284 for the proteins of SEQ No. 375, 427, 1878, 1904; 278-285 for the protein of sequence SEQ ID No. 351; 278-285 for the protein of sequence SEQ ID No. 352; 278-285 for the protein of sequence SEQ ID No. 429; 278-285 for the protein of sequence SEQ ID No. 430; 278-285 for the protein of sequence SEQ ID No. 442; 278-285 for the protein of sequence SEQ ID No. 444; 278-285 for the protein of sequence SEQ ID No. 445 | 2be |
| SEQ ID No. 461 | DVLASAAK | 278-285 for the proteins of SEQ No. 354, 363, 364, 365, 370, 371, 372, 373, 374, 382, 385, 388, 389, 390, 391, 393, 394, 395, 396, 399, 400, 401, 404, 405, 406, 412, 417, 426, 428, 431, 433, 437, 438, 1875, 1876, 1879, 1880, 1883, 1884, 1885, 1887, 1890, 1895, 1905, 1907, 1909; 277-284 for the protein of sequence SEQ ID No. 1898; 277-284 for the protein of sequence SEQ ID No. 1899; 277-284 for the protein of sequence SEQ ID No. 1902 | 2be |
| SEQ ID No. 462 | DVLASAAR | 278-285 for the proteins of SEQ No. 353, 355, 356, 359, 360, 361, 362, 367, 369, 376, 377, 378, 379, 380, 381, 387, 398, 402, 403, 407, 408, 409, 410, 411, 413, 421, 423, 436, 1872, 1873, 1874, 1877, 1882, 1886, 1888, 1889, 1891, 1892, 1893, 1894, 1896, 1897, 1900, 1901; 276-283 for the protein of sequence SEQ ID No. 425 | 2be |
| SEQ ID No. 463 | FAMCSTSK | 69-76 for the proteins of SEQ No. 351, 352, 354, 357, 358, 363, 364, 365, 366, 368, 370, 371, 372, 373, 374, 382, 383, 384, 385, 386, 388, 390, 391, 392, 393, 394, 395, 396, 397, 399, 400, 401, 404, 405, 406, 412, 414, 415, 416, 417, 418, 419, 420, 422, 424, 426, 429, 430, 431, 432, 433, 434, 435, 437, 438, 439, 440, 441, 442, 443, 444, 445, 1875, 1876, 1879, 1880, 1881, 1883, 1884, 1885, 1887, 1890, 1895, 1903, 1905, 1906, 1907, 1908, 1909; 68-75 for the protein of sequence SEQ ID No. 375; 68-75 for the protein of sequence SEQ ID No. 427; 68-75 for the protein of sequence SEQ ID No. 1878; 68-75 for the protein of sequence SEQ ID No. 1898; 68-75 for the protein of sequence SEQ ID No. 1899; 68-75 for the protein of sequence SEQ ID No. 1902; 68-75 for the protein of sequence SEQ ID No. 1904 | 2be |
| SEQ ID No. 464 | FPMCSTSK | 69-76 for the proteins of SEQ No. 353, 355, 356, 359, 360, 361, 362, 367, 369, 376, 377, 378, 379, 380, 381, 387, 389, 398, 402, 403, 407, 408, 409, 410, 411, 413, 421, 423, 425, 428, 436, 1872, 1873, 1874, 1877, 1882, 1886, 1888, 1889, 1891, 1892, 1893, 1894, 1896, 1897, 1900, 1901 | 2be |
| SEQ ID No. 465 | GNTTGAASIQAGLPASWVVGDK | 216-237 for the proteins of SEQ No. 354, 357, 358, 363, 364, 365, 370, 371, 372, 373, 374, 382, 385, 388, 389, 390, 391, 393, 394, 395, 396, 399, 400, 401, 404, 405, 406, 412, 417, 426, 431, 433, 437, 438, 440, 441, 1875, 1876, 1879, 1880, 1883, 1884, 1885, 1887, 1890, 1895, 1905, 1907, 1909; 215-236 for the protein of sequence SEQ ID No. 1899; 215-236 for the protein of sequence SEQ ID No. 1902 | 2be |
| SEQ ID No. 466 | GNTTGAASIQAGLPTSWVVGDK | 215-236 for the proteins of SEQ No. 375, 427, 1878, 1904; 216-237 for the protein of sequence SEQ ID No. 352; 216-237 for the protein of sequence SEQ ID No. 366; 216-237 for the protein of sequence SEQ ID No. 383; 216-237 for the protein of sequence SEQ ID No. 384; 216-237 for the protein of sequence SEQ ID No. 414; 216-237 for the protein of sequence SEQ ID No. | 2be |

-continued

| Peptide SEQ ID No. | Amino acid sequence | Position of the peptide in the CTX-M protein | Clinical interest |
|---|---|---|---|
| | | 418; 216-237 for the protein of sequence SEQ ID No. 420; 216-237 for the protein of sequence SEQ ID No. 443 | |
| SEQ ID No. 467 | GNTTGAASIR | 216-225 for the proteins of SEQ No. 353, 355, 356, 359, 360, 361, 362, 367, 368, 369, 377, 378, 379, 380, 381, 387, 398, 402, 403, 407, 408, 409, 410, 411, 413, 421, 423, 428, 436, 1872, 1873, 1874, 1877, 1882, 1886, 1888, 1889, 1891, 1892, 1893, 1894, 1896, 1897, 1900, 1901 | 2be |
| SEQ ID No. 468 | GNTTGSASIR | 216-225 for the proteins of SEQ No. 351, 386, 392, 397, 415, 416, 419, 422, 424, 429, 430, 432, 434, 435, 439, 444, 1881, 1903, 1906, 1908 | 2be |
| SEQ ID No. 469 | HLLNQR | 92-97 for the proteins of SEQ No. 351, 386, 397, 415, 416, 419, 422, 424, 429, 430, 432, 434, 435, 439, 442, 444, 445, 1881, 1903, 1906, 1908 | 2be |
| SEQ ID No. 470 | LAALEK | 36-41 for the proteins of SEQ No. 375, 427, 1878, 1904; 37-42 for the proteins of sequence SEQ ID No. 352, 353, 355, 356, 359, 360, 361, 362, 366, 367, 368, 369, 376, 377, 378, 379, 380, 381, 383, 384, 387, 398, 402, 403, 407, 408, 409, 410, 411, 413, 414, 418, 420, 421, 423, 425, 436, 443, 1872, 1873, 1874, 1877, 1882, 1886, 1888, 1889, 1891, 1892, 1893, 1894, 1896, 1897, 1900, 1901 | 2be |
| SEQ ID No. 471 | LAELER | 37-42 for the proteins of SEQ No. 358, 363, 364, 365, 370, 371, 372, 382, 385, 388, 389, 391, 393, 394, 395, 396, 399, 400, 401, 404, 405, 406, 412, 417, 426, 428, 431, 433, 437, 438, 440, 441, 1875, 1876, 1879, 1880, 1883, 1884, 1885, 1887, 1890, 1895, 1905, 1907, 1909; 36-41 for the protein of sequence SEQ ID No. 1898; 36-41 for the protein of sequence SEQ ID No. 1899; 36-41 for the protein of sequence SEQ ID No. 1902 | 2be |
| SEQ ID No. 472 | LGVALIDTADNTQVLYR | 48-64 for the proteins of SEQ No. 353, 355, 359, 360, 361, 362, 367, 369, 376, 377, 378, 387, 398, 402, 403, 407, 409, 410, 411, 413, 421, 423, 425, 436, 1872, 1873, 1874, 1877, 1882, 1886, 1888, 1889, 1891, 1892, 1893, 1894, 1896, 1897, 1900, 1901 | 2be |
| SEQ ID No. 473 | LGVALINTADNSQILYR | 48-64 for the proteins of SEQ No. 351, 354, 357, 358, 363, 364, 365, 370, 371, 372, 373, 374, 382, 385, 386, 388, 389, 390, 391, 392, 393, 394, 395, 396, 397, 399, 400, 401, 404, 405, 406, 412, 415, 416, 417, 419, 422, 424, 426, 428, 431, 432, 433, 435, 437, 438, 439, 440, 441, 442, 444, 445, 1875, 1876, 1879, 1880, 1881, 1883, 1884, 1885, 1887, 1890, 1895, 1903, 1905, 1906, 1907, 1908, 1909; 47-63 for the protein of sequence SEQ ID No. 1898; 47-63 for the protein of sequence SEQ ID No. 1899 | 2be |
| SEQ ID No. 474 | LIAHLGGPDK | 141-150 for the proteins of SEQ No. 351, 352, 366, 368, 383, 384, 386, 392, 397, 414, 415, 416, 418, 419, 420, 422, 424, 429, 430, 432, 434, 435, 439, 442, 444, 445, 1881, 1903, 1906, 1908; 140-149 for the protein of sequence SEQ ID No. 375; 140-149 for the protein of sequence SEQ ID No. 427; 140-149 for the protein of sequence SEQ ID No. 1878; 140-149 for the protein of sequence SEQ ID No. 1904 | 2be |
| SEQ ID No. 475 | LIAHVGGPASVTAFAR | 141-156 for the proteins of SEQ No. 354, 357, 358, 363, 364, 365, 370, 371, 372, 373, 374, 382, 385, 388, 389, 390, 391, 393, 394, 399, 400, 401, 404, 405, 406, 412, 417, 433, 437, 440, 441, 1875, 1876, 1879, 1883, 1884, 1885, 1887, 1890, 1895, 1907, 1909; 140-155 for the protein of sequence SEQ ID No. 1898; 140-155 for the protein of sequence SEQ ID No. 1899; 140-155 for the protein of sequence SEQ ID No. 1902 | 2be |
| SEQ ID No. 476 | LIAQLGGPGGVTAFAR | 141-156 for the proteins of SEQ No. 353, 355, 356, 359, 360, 361, 362, 367, 369, 376, 377, 378, 379, 380, 381, 387, 398, 402, 403, 407, 408, 409, 410, 411, 413, 421, 423, 425, 428, 436, 1872, 1873, 1874, 1877, 1882, 1886, 1888, 1889, 1891, 1892, 1893, 1894, 1896, 1900, 1901 | 2be |

-continued

| Peptide SEQ ID No. | Amino acid sequence | Position of the peptide in the CTX-M protein | Clinical interest |
|---|---|---|---|
| SEQ ID No. 477 | NLTLGK | 195-200 for the proteins of SEQ No. 351, 354, 357, 358, 363, 364, 365, 370, 371, 372, 373, 374, 382, 385, 386, 388, 389, 390, 391, 392, 393, 394, 395, 396, 397, 399, 400, 401, 404, 405, 406, 412, 415, 416, 417, 419, 422, 424, 426, 429, 430, 431, 432, 433, 434, 435, 437, 438, 439, 440, 441, 442, 444, 445, 1875, 1876, 1879, 1880, 1881, 1883, 1884, 1885, 1887, 1890, 1895, 1903, 1905, 1906, 1907, 1908, 1909; 194-199 for the protein of sequence SEQ ID No. 1898; 194-199 for the protein of sequence SEQ ID No. 1899; 194-199 for the protein of sequence SEQ ID No. 1902 | 2be |
| SEQ ID No. 478 | QLGDETFR | 157-164 for the proteins of SEQ No. 354, 357, 358, 363, 364, 365, 370, 371, 372, 373, 374, 382, 385, 388, 389, 390, 391, 393, 394, 395, 396, 399, 400, 401, 405, 406, 412, 417, 426, 431, 433, 437, 438, 440, 441, 1875, 1876, 1879, 1880, 1883, 1884, 1885, 1887, 1890, 1895, 1905, 1907, 1909; 156-163 for the protein of sequence SEQ ID No. 1898; 156-163 for the protein of sequence SEQ ID No. 1899; 156-163 for the protein of sequence SEQ ID No. 1902 | 2be |
| SEQ ID No. 479 | QLLNQPVEIK | 92-101 for the proteins of SEQ No. 353, 355, 356, 359, 360, 361, 362, 367, 369, 376, 377, 378, 379, 380, 381, 387, 398, 402, 407, 408, 409, 410, 411, 413, 421, 423, 425, 428, 436, 1872, 1873, 1874, 1877, 1882, 1886, 1888, 1889, 1891, 1892, 1893, 1894, 1896, 1897, 1900, 1901 | 2be |
| SEQ ID No. 480 | QLTLGHALGETQR | 195-207 for the proteins of SEQ No. 353, 355, 356, 359, 360, 361, 362, 367, 369, 376, 377, 378, 379, 380, 381, 387, 398, 402, 403, 407, 408, 409, 410, 411, 413, 421, 423, 428, 436, 1872, 1873, 1874, 1877, 1882, 1886, 1888, 1889, 1891, 1892, 1893, 1894, 1896, 1897, 1900, 1901 | 2be |
| SEQ ID No. 481 | QSESDK | 86-91 for the proteins of SEQ No. 351, 386, 392, 397, 415, 416, 419, 422, 424, 429, 430, 432, 434, 435, 439, 442, 444, 445, 1881, 1903, 1906, 1908 | 2be |
| SEQ ID No. 482 | QSETQK | 85-90 for the proteins of SEQ No. 375, 427, 1878, 1904; 86-91 for the protein of sequence SEQ ID No. 352; 86-91 for the protein of sequence SEQ ID No. 353; 86-91 for the protein of sequence SEQ ID No. 355; 86-91 for the protein of sequence SEQ ID No. 356; 86-91 for the protein of sequence SEQ ID No. 359; 86-91 for the protein of sequence SEQ ID No. 360; 86-91 for the protein of sequence SEQ ID No. 361; 86-91 for the protein of sequence SEQ ID No. 362; 86-91 for the protein of sequence SEQ ID No. 366; 86-91 for the protein of sequence SEQ ID No. 367; 86-91 for the protein of sequence SEQ ID No. 368; 86-91 for the protein of sequence SEQ ID No. 369; 86-91 for the protein of sequence SEQ ID No. 376; 86-91 for the protein of sequence SEQ ID No. 377; 86-91 for the protein of sequence SEQ ID No. 378; 86-91 for the protein of sequence SEQ ID No. 379; 86-91 for the protein of sequence SEQ ID No. 380; 86-91 for the protein of sequence SEQ ID No. 381; 86-91 for the protein of sequence SEQ ID No. 383; 86-91 for the protein of sequence SEQ ID No. 384; 86-91 for the protein of sequence SEQ ID No. 387; 86-91 for the protein of sequence SEQ ID No. 398; 86-91 for the protein of sequence SEQ ID No. 402; 86-91 for the protein of sequence SEQ ID No. 403; 86-91 for the protein of sequence SEQ ID No. 407; 86-91 for the protein of sequence SEQ ID No. 408; 86-91 for the protein of sequence SEQ ID No. 409; 86-91 for the protein of sequence SEQ ID No. 410; 86-91 for the protein of sequence SEQ ID No. 411; 86-91 for the protein of sequence SEQ ID No. 413; 86-91 for the protein of sequence SEQ ID No. 414; 86-91 for the protein of sequence SEQ ID No. 418; 86-91 for the protein of sequence SEQ ID No. 420; 86-91 for the protein of sequence SEQ ID No. 421; 86-91 for the protein of sequence SEQ ID No. 423; 86-91 for the protein of sequence SEQ ID No. 425; 86-91 for the | 2be |

-continued

| Peptide SEQ ID No. | Amino acid sequence | Position of the peptide in the CTX-M protein | Clinical interest |
|---|---|---|---|
| | | protein of sequence SEQ ID No. 428; 86-91 for the protein of sequence SEQ ID No. 436; 86-91 for the protein of sequence SEQ ID No. 443; 86-91 for the protein of sequence SEQ ID No. 1872; 86-91 for the protein of sequence SEQ ID No. 1873; 86-91 for the protein of sequence SEQ ID No. 1874; 86-91 for the protein of sequence SEQ ID No. 1877; 86-91 for the protein of sequence SEQ ID No. 1882; 86-91 for the protein of sequence SEQ ID No. 1886; 86-91 for the protein of sequence SEQ ID No. 1888; 86-91 for the protein of sequence SEQ ID No. 1889; 86-91 for the protein of sequence SEQ ID No. 1891; 86-91 for the protein of sequence SEQ ID No. 1892; 86-91 for the protein of sequence SEQ ID No. 1893; 86-91 for the protein of sequence SEQ ID No. 1894; 86-91 for the protein of sequence SEQ ID No. 1896; 86-91 for the protein of sequence SEQ ID No. 1897; 86-91 for the protein of sequence SEQ ID No. 1900 | |
| SEQ ID No. 483 | QSGGR | 43-47 for the proteins of SEQ No. 354, 357, 358, 363, 364, 365, 370, 371, 372, 373, 374, 382, 385, 388, 389, 390, 391, 393, 394, 395, 396, 399, 400, 401, 404, 405, 406, 412, 417, 426, 428, 431, 433, 437, 438, 440, 441, 1875, 1876, 1879, 1880, 1883, 1884, 1885, 1887, 1890, 1895, 1905, 1907, 1909; 42-46 for the protein of sequence SEQ ID No. 1898; 42-46 for the protein of sequence SEQ ID No. 1899; 42-46 for the protein of sequence SEQ ID No. 1902 | 2be |
| SEQ ID No. 484 | SDLVNYNPIAEK | 103-114 for the proteins of SEQ No. 351, 354, 357, 358, 363, 364, 365, 371, 372, 373, 374, 382, 384, 385, 386, 388, 389, 390, 391, 392, 393, 394, 395, 396, 397, 399, 400, 401, 404, 405, 406, 412, 415, 416, 417, 419, 422, 424, 426, 429, 430, 431, 432, 433, 434, 435, 437, 438, 439, 440, 441, 442, 444, 445, 1875, 1876, 1879, 1880, 1881, 1883, 1884, 1885, 1887, 1890, 1895, 1903, 1905, 1906, 1907, 1908, 1909; 102-113 for the protein of sequence SEQ ID No. 1898; 102-113 for the protein of sequence SEQ ID No. 1899; 102-113 for the protein of sequence SEQ ID No. 1902 | 2be |
| SEQ ID No. 485 | SESEPNLLNQR | 87-97 for the proteins of SEQ No. 354, 357, 363, 364, 365, 370, 371, 372, 373, 374, 382, 385, 388, 389, 390, 391, 393, 394, 395, 396, 399, 400, 401, 404, 405, 406, 412, 417, 426, 431, 433, 437, 438, 1875, 1876, 1879, 1880, 1883, 1884, 1885, 1887, 1890, 1895, 1905, 1907, 1909; 86-96 for the protein of sequence SEQ ID No. 1898; 86-96 for the protein of sequence SEQ ID No. 1899; 86-96 for the protein of sequence SEQ ID No. 1902 | 2be |
| SEQ ID No. 486 | SLGDETFR | 157-164 for the proteins of SEQ No. 351, 386, 392, 397, 415, 416, 419, 422, 424, 429, 430, 432, 434, 435, 442, 444, 445, 1881, 1903, 1906, 1908 | 2be |
| SEQ ID No. 487 | SSGGR | 43-47 for the proteins of SEQ No. 351, 352, 353, 355, 356, 359, 360, 361, 362, 366, 367, 368, 369, 376, 378, 380, 381, 383, 384, 386, 387, 392, 397, 398, 402, 403, 407, 408, 409, 410, 411, 413, 414, 415, 416, 418, 419, 420, 421, 422, 423, 424, 425, 429, 430, 432, 434, 435, 436, 439, 442, 443, 444, 445, 1872, 1873, 1874, 1877, 1881, 1882, 1886, 1888, 1889, 1891, 1892, 1893, 1894, 1896, 1897, 1900, 1901, 1903, 1906, 1908; 42-46 for the protein of sequence SEQ ID No. 375; 42-46 for the protein of sequence SEQ ID No. 427; 42-46 for the protein of sequence SEQ ID No. 1878; 42-46 for the protein of sequence SEQ ID No. 1904 | 2be |
| SEQ ID No. 488 | SWVVGDK | 231-237 for the proteins of SEQ No. 352, 354, 357, 358, 363, 364, 365, 366, 368, 370, 371, 372, 373, 374, 382, 383, 384, 385, 386, 388, 389, 390, 391, 392, 393, 394, 395, 396, 397, 399, 400, 401, 404, 405, 406, 412, 414, 415, 416, 417, 418, 419, 420, 422, 424, 426, 428, 431, 432, 433, 435, 437, 438, 439, 440, 441, 442, 443, 445, 1875, 1876, 1879, 1880, 1881, 1883, 1884, 1885, 1887, 1890, 1895, 1903, 1905, 1906, 1907, 1908, 1909; 230-236 | 2be |

| Peptide SEQ ID No. | Amino acid sequence | Position of the peptide in the CTX-M protein | Clinical interest |
|---|---|---|---|
| | | for the protein of sequence SEQ ID No. 375; 230-236 for the protein of sequence SEQ ID No. 427; 230-236 for the protein of sequence SEQ ID No. 1878; 230-236 for the protein of sequence SEQ ID No. 1899; 230-236 for the protein of sequence SEQ ID No. 1902; 230-236 for the protein of sequence SEQ ID No. 1904 | |
| SEQ ID No. 489 | TEPTLNTAIPGDPR | 168-181 for the proteins of SEQ No. 351, 352, 353, 354, 355, 356, 357, 358, 359, 360, 362, 363, 364, 366, 367, 368, 369, 370, 371, 372, 373, 374, 376, 377, 378, 379, 380, 381, 382, 383, 384, 386, 387, 389, 390, 392, 393, 394, 396, 397, 398, 399, 401, 402, 403, 404, 405, 406, 408, 409, 410, 411, 412, 413, 414, 416, 417, 418, 419, 420, 422, 423, 424, 425, 426, 428, 431, 432, 433, 435, 436, 437, 438, 439, 440, 441, 442, 443, 444, 445, 1872, 1874, 1875, 1876, 1877, 1879, 1880, 1881, 1882, 1883, 1884, 1885, 1886, 1887, 1890, 1891, 1892, 1893, 1894, 1895, 1896, 1897, 1900, 1901, 1903, 1905, 1906, 1907, 1908, 1909; 167-180 for the protein of sequence SEQ ID No. 375; 167-180 for the protein of sequence SEQ ID No. 427; 167-180 for the protein of sequence SEQ ID No. 1878; 167-180 for the protein of sequence SEQ ID No. 1898; 167-180 for the protein of sequence SEQ ID No. 1899; 167-180 for the protein of sequence SEQ ID No. 1902; 167-180 for the protein of sequence SEQ ID No. 1904 | 2be |
| SEQ ID No. 490 | TGSGDYGTTNDIAVIWPK | 238-255 for the proteins of SEQ No. 354, 357, 358, 364, 365, 372, 374, 382, 385, 388, 391, 395, 396, 400, 401, 404, 405, 426, 431, 433, 441, 1876, 1880, 1895, 1905, 1907 | 2be |
| SEQ ID No. 491 | TGSGDYGTTNDIAVIWPQGR | 238-257 for the proteins of SEQ No. 353, 355, 356, 360, 361, 362, 367, 376, 377, 378, 379, 380, 381, 387, 398, 402, 403, 407, 408, 409, 410, 411, 413, 421, 436, 1872, 1873, 1874, 1877, 1882, 1886, 1888, 1893, 1894, 1896, 1897, 1900, 1901; 236-255 for the protein of sequence SEQ ID No. 425 | 2be |
| SEQ ID No. 492 | TGSGGYGTTNDIAVIWPK | 238-255 for the proteins of SEQ No. 363, 370, 371, 389, 390, 393, 394, 399, 406, 412, 428, 437, 438, 440, 1875, 1879, 1883, 1884, 1885, 1887, 1890, 1909; 237-254 for the protein of sequence SEQ ID No. 1898; 237-254 for the protein of sequence SEQ ID No. 1899; 237-254 for the protein of sequence SEQ ID No. 1902 | 2be |
| SEQ ID No. 493 | VMAAAAVLK | 77-85 for the proteins of SEQ No. 351, 352, 353, 354, 355, 356, 357, 358, 359, 360, 361, 362, 363, 364, 367, 368, 369, 370, 371, 372, 373, 374, 376, 377, 378, 379, 380, 381, 382, 383, 384, 385, 386, 389, 391, 392, 397, 400, 401, 402, 404, 405, 408, 409, 410, 411, 412, 415, 416, 417, 419, 420, 421, 422, 424, 425, 426, 428, 429, 430, 432, 433, 434, 435, 436, 437, 439, 440, 442, 443, 444, 1872, 1873, 1874, 1875, 1876, 1877, 1881, 1885, 1888, 1889, 1890, 1891, 1893, 1894, 1896, 1897, 1900, 1901, 1903, 1906, 1907, 1908, 1909; 76-84 for the protein of sequence SEQ ID No. 375; 76-84 for the protein of sequence SEQ ID No. 427; 76-84 for the protein of sequence SEQ ID No. 1878; 76-84 for the protein of sequence SEQ ID No. 1898; 76-84 for the protein of sequence SEQ ID No. 1899; 76-84 for the protein of sequence SEQ ID No. 1902; 76-84 for the protein of sequence SEQ ID No. 1904 | 2be |
| SEQ ID No. 494 | VMAVAAVLK | 77-85 for the proteins of SEQ No. 365, 366, 387, 388, 390, 393, 394, 395, 396, 398, 399, 406, 407, 413, 414, 418, 423, 431, 438, 441, 1879, 1880, 1882, 1883, 1884, 1886, 1892, 1895, 1905 | 2be |
| SEQ ID No. 495 | VTAFAR | 151-156 for the proteins of SEQ No. 351, 352, 353, 354, 355, 356, 357, 358, 359, 360, 361, 362, 363, 364, 365, 366, 367, 368, 369, 370, 371, 372, 373, 374, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, | 2be |

| Peptide SEQ ID No. | Amino acid sequence | Position of the peptide in the CTX-M protein | Clinical interest |
|---|---|---|---|
| | | 411, 412, 413, 414, 415, 416, 417, 418, 419, 420, 421, 422, 423, 424, 425, 426, 428, 429, 430, 431, 432, 433, 434, 435, 436, 437, 438, 439, 440, 441, 442, 443, 444, 445, 1872, 1873, 1874, 1875, 1876, 1877, 1879, 1880, 1881, 1882, 1883, 1884, 1885, 1886, 1887, 1888, 1889, 1890, 1891, 1892, 1893, 1894, 1895, 1896, 1897, 1900, 1901, 1903, 1905, 1906, 1907, 1908, 1909; 150-155 for the protein of sequence SEQ ID No. 375; 150-155 for the protein of sequence SEQ ID No. 427; 150-155 for the protein of sequence SEQ ID No. 1878; 150-155 for the protein of sequence SEQ ID No. 1898; 150-155 for the protein of sequence SEQ ID No. 1899; 150-155 for the protein of sequence SEQ ID No. 1902; 150-155 for the protein of sequence SEQ ID No. 1904 | |
| SEQ ID No. 2008 | AAGIR | 219-223 for the protein of SEQ No. 425 | 2be |
| SEQ ID No. 2009 | AGADVASLR | 188-196 for the protein of SEQ No. 425 | 2be |
| SEQ ID No. 2010 | AGLPASWVVGDK | 226-237 for the proteins of SEQ No. 354, 357, 358, 363, 364, 365, 370, 371, 372, 373, 374, 382, 385, 388, 389, 390, 391, 393, 394, 395, 396, 399, 400, 401, 404, 405, 406, 412, 417, 426, 428, 431, 433, 437, 438, 440, 441, 1875, 1876, 1879, 1880, 1883, 1884, 1885, 1887, 1890, 1895, 1905, 1907, 1909; 225-236 for the protein of sequence SEQ ID No. 1899; 225-236 for the protein of sequence SEQ ID No. 1902 | 2be |
| SEQ ID No. 2011 | AGLPTSWTAGDK | 226-237 for the proteins of SEQ No. 353, 359, 387 | 2be |
| SEQ ID No. 2012 | AGLPTSWTVGDR | 226-237 for the proteins of SEQ No. 1894 | 2be |
| SEQ ID No. 2013 | AGLPTSWVVGDK | 225-236 for the proteins of SEQ No. 375, 427, 1878, 1904; 226-237 for the protein of sequence SEQ ID No. 352; 226-237 for the protein of sequence SEQ ID No. 366; 226-237 for the protein of sequence SEQ ID No. 368; 226-237 for the protein of sequence SEQ ID No. 383; 226-237 for the protein of sequence SEQ ID No. 384; 226-237 for the protein of sequence SEQ ID No. 414; 226-237 for the protein of sequence SEQ ID No. 418; 226-237 for the protein of sequence SEQ ID No. 420; 226-237 for the protein of sequence SEQ ID No. 443 | 2be |
| SEQ ID No. 2014 | AGMPK | 226-230 for the protein of SEQ No. 434 | 2be |
| SEQ ID No. 2015 | AIGDDTFR | 156-163 for the proteins of SEQ No. 375, 427, 1878, 1904 | 2be |
| SEQ ID No. 2016 | AIGDNTFR | 157-164 for the protein of SEQ No. 352 | 2be |
| SEQ ID No. 2017 | AMAVAAVLK | 77-85 for the proteins of SEQ No. 1887 | 2be |
| SEQ ID No. 2018 | APLILVIYFTQPQPK | 258-272 for the protein of SEQ No. 390 | 2be |
| SEQ ID No. 2019 | APLILVTYFTQPEQK | 257-271 for the proteins of SEQ No. 375, 427, 1878, 1904; 258-272 for the protein of sequence SEQ ID No. 352 | 2be |
| SEQ ID No. 2020 | APLILVTYFTQPQPNAESR | 258-276 for the proteins of SEQ No. 406, 1884 | 2be |
| SEQ ID No. 2021 | APLVLVTYFTQPEPK | 258-272 for the protein of SEQ No. 443 | 2be |
| SEQ ID No. 2022 | APLVLVTYFTQPQQNAENR | 258-276 for the proteins of SEQ No. 1893 | 2be |

| Peptide SEQ ID No. | Amino acid sequence | Position of the peptide in the CTX-M protein | Clinical interest |
|---|---|---|---|
| SEQ ID No. 2023 | APLVLVTYFTQPQQNAER | 258-275 for the proteins of SEQ No. 367, 398, 421, 1877, 1882, 1888 | 2be |
| SEQ ID No. 2024 | APLVLVTYFTQSEPK | 258-272 for the proteins of SEQ No. 366, 368, 383, 384, 414, 418, 420 | 2be |
| SEQ ID No. 2025 | AQLVAWLK | 208-215 for the protein of SEQ No. 409 | 2be |
| SEQ ID No. 2026 | AQLVMWLK | 208-215 for the proteins of SEQ No. 366, 368, 383, 384, 414, 418, 420 | 2be |
| SEQ ID No. 2027 | ASDLVNYNPIAEK | 102-114 for the proteins of SEQ No. 429, 430, 434 | 2be |
| SEQ ID No. 2028 | CWVVGDK | 231-237 for the protein of SEQ No. 429 | 2be |
| SEQ ID No. 2029 | DFLAAAAK | 278-285 for the proteins of SEQ No. 435, 1908 | 2be |
| SEQ ID No. 2030 | DILASAAK | 278-285 for the proteins of SEQ No. 358, 440, 441 | 2be |
| SEQ ID No. 2031 | DLLSQR | 92-97 for the protein of SEQ No. 443 | 2be |
| SEQ ID No. 2032 | DNTQVLYR | 57-64 for the proteins of SEQ No. 353, 355, 356, 359, 360, 361, 362, 367, 369, 376, 377, 378, 379, 380, 381, 387, 398, 402, 403, 407, 409, 410, 411, 413, 421, 423, 425, 436, 1872, 1873, 1874, 1877, 1882, 1886, 1888, 1889, 1891, 1892, 1893, 1894, 1896, 1897, 1900, 1901 | 2be |
| SEQ ID No. 2033 | DTTTAR | 182-187 for the protein of SEQ No. 425 | 2be |
| SEQ ID No. 2034 | DTTTPLAMAQALR | 182-194 for the proteins of SEQ No. 366, 368, 383, 384, 414, 420 | 2be |
| SEQ ID No. 2035 | DTTTPLAMAQSLR | 182-194 for the protein of SEQ No. 418 | 2be |
| SEQ ID No. 2036 | DTTTPLAMAQTLR | 181-193 for the proteins of SEQ No. 375, 427, 1878, 1904; 182-194 for the protein of sequence SEQ ID No. 352; 182-194 for the protein of sequence SEQ ID No. 443 | 2be |
| SEQ ID No. 2037 | DVLAAAAR | 278-285 for the proteins of SEQ No. 366, 368, 383, 384, 414, 418, 420, 443 | 2be |
| SEQ ID No. 2038 | EIGDETFR | 157-164 for the protein of SEQ No. 356 | 2be |
| SEQ ID No. 2039 | EQLVTWLK | 208-215 for the proteins of SEQ No. 1891, 1892 | 2be |
| SEQ ID No. 2040 | GLLSQR | 92-97 for the proteins of SEQ No. 366, 368, 383, 384, 414, 418, 420 | 2be |
| SEQ ID No. 2041 | GNTTGAAR | 216-223 for the protein of SEQ No. 376 | 2be |
| SEQ ID No. 2042 | GNTTGSASIQAGLPK | 216-230 for the proteins of SEQ No. 442, 445 | 2be |
| SEQ ID No. 2043 | HDVLASAAK | 277-285 for the proteins of SEQ No. 412, 1885 | 2be |
| SEQ ID No. 2044 | HDVLASAAR | 277-285 for the proteins of SEQ No. 1894 | 2be |
| SEQ ID No. 2045 | HLTLGSALGETQR | 194-206 for the proteins of SEQ No. 375, 427, 1878, 1904 | 2be |
| SEQ ID No. 2046 | LAELEQQSGGR | 37-47 for the proteins of SEQ No. 354, 373, 374, 390 | 2be |

-continued

| Peptide SEQ ID No. | Amino acid sequence | Position of the peptide in the CTX-M protein | Clinical interest |
|---|---|---|---|
| SEQ ID No. 2047 | LAGLER | 37-42 for the protein of SEQ No. 357 | 2be |
| SEQ ID No. 2048 | LDGTEPTLNTAIPGDPR | 165-181 for the protein of SEQ No. 382 | 2be |
| SEQ ID No. 2049 | LGVALIDTADNAQTLYR | 47-63 for the proteins of SEQ No. 375, 427, 1878, 1904; 48-64 for the protein of sequence SEQ ID No. 352 | 2be |
| SEQ ID No. 2050 | LGVALIDTADNTHVLYR | 48-64 for the protein of SEQ No. 408 | 2be |
| SEQ ID No. 2051 | LGVALIDTK | 48-56 for the protein of SEQ No. 356 | 2be |
| SEQ ID No. 2052 | LGVALINTADNSQILYLADER | 48-68 for the protein of SEQ No. 429 | 2be |
| SEQ ID No. 2053 | LGVALINTADNSQILYVADER | 48-68 for the protein of SEQ No. 430 | 2be |
| SEQ ID No. 2054 | LGVALINTADNSR | 47-59 for the proteins of SEQ No. 1902 | 2be |
| SEQ ID No. 2055 | LGVALINTADNTQTLYR | 48-64 for the proteins of SEQ No. 366, 368, 383, 384, 414, 418, 420, 443 | 2be |
| SEQ ID No. 2056 | LGVAQINTADNSQILYVADER | 48-68 for the protein of SEQ No. 434 | 2be |
| SEQ ID No. 2057 | LGVPLIDTADNTQVLYR | 48-64 for the proteins of SEQ No. 379, 380, 381 | 2be |
| SEQ ID No. 2058 | LIAHLGGPGK | 141-150 for the protein of SEQ No. 443 | 2be |
| SEQ ID No. 2059 | LIAQLGGQGGVTAFAR | 141-156 for the proteins of SEQ No. 1897 | 2be |
| SEQ ID No. 2060 | LISHVGGPASVTAFAR | 141-156 for the proteins of SEQ No. 395, 396, 426, 431, 438, 1880, 1905 | 2be |
| SEQ ID No. 2061 | LLLNQR | 92-97 for the protein of SEQ No. 392 | 2be |
| SEQ ID No. 2062 | NLTLGNALGDTQR | 195-207 for the proteins of SEQ No. 366, 368, 383, 384, 414, 418, 420, 443 | 2be |
| SEQ ID No. 2063 | NLTLGSALGETQR | 195-207 for the protein of SEQ No. 352 | 2be |
| SEQ ID No. 2064 | NVLSQK | 91-96 for the proteins of SEQ No. 375, 427, 1878, 1904 | 2be |
| SEQ ID No. 2065 | QLGDDTFR | 157-164 for the protein of SEQ No. 404 | 2be |
| SEQ ID No. 2066 | SDLVNYSPIAEK | 103-114 for the protein of SEQ No. 370 | 2be |
| SEQ ID No. 2067 | SESEPSLLNQR | 87-97 for the proteins of SEQ No. 358, 440, 441 | 2be |
| SEQ ID No. 2068 | SETQK | 86-90 for the proteins of SEQ No. 375, 427, 1878, 1904; 87-91 for the protein of sequence SEQ ID No. 352; 87-91 for the protein of sequence SEQ ID No. 353; 87-91 for the protein of sequence SEQ ID No. 355; 87-91 for the protein of sequence SEQ ID No. 356; 87-91 for the protein of sequence SEQ ID No. 359; 87-91 for the protein of sequence SEQ ID No. 360; 87-91 for the protein of sequence SEQ ID No. 361; 87-91 for the protein of sequence SEQ ID No. 362; 87-91 for the protein of sequence SEQ ID No. 366; 87-91 for the protein of sequence SEQ ID No. 367; 87-91 for the protein of sequence SEQ ID No. 368; 87-91 for the | 2be |

-continued

| Peptide SEQ ID No. | Amino acid sequence | Position of the peptide in the CTX-M protein | Clinical interest |
|---|---|---|---|
| | | protein of sequence SEQ ID No. 369; 87-91 for the protein of sequence SEQ ID No. 376; 87-91 for the protein of sequence SEQ ID No. 377; 87-91 for the protein of sequence SEQ ID No. 378; 87-91 for the protein of sequence SEQ ID No. 379; 87-91 for the protein of sequence SEQ ID No. 380; 87-91 for the protein of sequence SEQ ID No. 381; 87-91 for the protein of sequence SEQ ID No. 383; 87-91 for the protein of sequence SEQ ID No. 384; 87-91 for the protein of sequence SEQ ID No. 387; 87-91 for the protein of sequence SEQ ID No. 398; 87-91 for the protein of sequence SEQ ID No. 402; 87-91 for the protein of sequence SEQ ID No. 403; 87-91 for the protein of sequence SEQ ID No. 407; 87-91 for the protein of sequence SEQ ID No. 408; 87-91 for the protein of sequence SEQ ID No. 409; 87-91 for the protein of sequence SEQ ID No. 410; 87-91 for the protein of sequence SEQ ID No. 411; 87-91 for the protein of sequence SEQ ID No. 413; 87-91 for the protein of sequence SEQ ID No. 414; 87-91 for the protein of sequence SEQ ID No. 418; 87-91 for the protein of sequence SEQ ID No. 420; 87-91 for the protein of sequence SEQ ID No. 421; 87-91 for the protein of sequence SEQ ID No. 423; 87-91 for the protein of sequence SEQ ID No. 425; 87-91 for the protein of sequence SEQ ID No. 428; 87-91 for the protein of sequence SEQ ID No. 436; 87-91 for the protein of sequence SEQ ID No. 443; 87-91 for the protein of sequence SEQ ID No. 1872; 87-91 for the protein of sequence SEQ ID No. 1873; 87-91 for the protein of sequence SEQ ID No. 1874; 87-91 for the protein of sequence SEQ ID No. 1877; 87-91 for the protein of sequence SEQ ID No. 1882; 87-91 for the protein of sequence SEQ ID No. 1886; 87-91 for the protein of sequence SEQ ID No. 1888; 87-91 for the protein of sequence SEQ ID No. 1889; 87-91 for the protein of sequence SEQ ID No. 1891; 87-91 for the protein of sequence SEQ ID No. 1892; 87-91 for the protein of sequence SEQ ID No. 1893; 87-91 for the protein of sequence SEQ ID No. 1894; 87-91 for the protein of sequence SEQ ID No. 1896; 87-91 for the protein of sequence SEQ ID No. 1897; 87-91 for the protein of sequence SEQ ID No. 1900; 87-91 for the protein of sequence SEQ ID No. 1901 | |
| SEQ ID No. 2069 | SLGDESFR | 157-164 for the protein of SEQ No. 439 | 2be |
| SEQ ID No. 2070 | SSDLINYNPIAEK | 101-113 for the proteins of SEQ No. 375, 427, 1878, 1904; 102-114 for the protein of sequence SEQ ID No. 443 | 2be |
| SEQ ID No. 2071 | SSDLINYNPITEK | 102-114 for the protein of SEQ No. 352 | 2be |
| SEQ ID No. 2072 | SWGVGDK | 231-237 for the proteins of SEQ No. 351, 430, 434, 444 | 2be |
| SEQ ID No. 2073 | TELTLNTAIPGDPR | 168-181 for the protein of SEQ No. 407 | 2be |
| SEQ ID No. 2074 | TEPTLNSAIPGDPR | 168-181 for the proteins of SEQ No. 429, 430, 434 | 2be |
| SEQ ID No. 2075 | TEPTQNTAIPGDPR | 168-181 for the protein of SEQ No. 1889 | 2be |
| SEQ ID No. 2076 | TEQTLNTAIPGDPR | 168-181 for the protein of SEQ No. 391 | 2be |
| SEQ ID No. 2077 | TESTLNTAIPGDPR | 168-181 for the proteins of SEQ No. 361, 388, 400, 421, 1873, 1888 | 2be |
| SEQ ID No. 2078 | TETTLNTAIPGDPR | 168-181 for the proteins of SEQ No. 365, 385, 395, 415 | 2be |

-continued

| Peptide SEQ ID No. | Amino acid sequence | Position of the peptide in the CTX-M protein | Clinical interest |
|---|---|---|---|
| SEQ ID No. 2079 | TGSCDYGTTNDIAVIWPK | 238-255 for the protein of SEQ No. 373 | 2be |
| SEQ ID No. 2080 | TGSCGYGTTNDIAVIWPK | 238-255 for the protein of SEQ No. 417 | 2be |
| SEQ ID No. 2081 | TGSGDYGTTNDIAVIWPEGR | 237-256 for the proteins of SEQ No. 375, 427, 1878, 1904; 238-257 for the protein of sequence SEQ ID No. 352; 238-257 for the protein of sequence SEQ ID No. 368; 238-257 for the protein of sequence SEQ ID No. 383; 238-257 for the protein of sequence SEQ ID No. 414; 238-257 for the protein of sequence SEQ ID No. 418; 238-257 for the protein of sequence SEQ ID No. 443 | 2be |
| SEQ ID No. 2082 | TGSGGYGTTNDIAVIWPEGR | 238-257 for the proteins of SEQ No. 366, 384, 420 | 2be |
| SEQ ID No. 2083 | TGSGGYGTTNDIAVIWPQGR | 238-257 for the proteins of SEQ No. 359, 369, 423, 1889, 1891, 1892 | 2be |
| SEQ ID No. 2084 | TIGDDTFR | 157-164 for the proteins of SEQ No. 366, 368, 383, 384, 414, 418, 420 | 2be |
| SEQ ID No. 2085 | TQLVTWLK | 208-215 for the protein of SEQ No. 419 | 2be |
| SEQ ID No. 2086 | VEIKPSDLINYNPIAEK | 98-114 for the proteins of SEQ No. 366, 368, 383, 414, 418, 420 | 2be |
| SEQ ID No. 2087 | VEIKPSDLVNYNPIAEK | 98-114 for the protein of SEQ No. 384 | 2be |
| SEQ ID No. 2088 | VIGDDTFR | 157-164 for the protein of SEQ No. 443 | 2be |
| SEQ ID No. 2089 | VLSQK | 92-96 for the proteins of SEQ No. 375, 427, 1878, 1904; 93-97 for the protein of sequence SEQ ID No. 352 | 2be |
| SEQ ID No. 2090 | VMAAAALLK | 77-85 for the protein of SEQ No. 445 | 2be |
| SEQ ID No. 2091 | VMAAAAVLEQSETQK | 77-91 for the protein of SEQ No. 403 | 2be |
| SEQ ID No. 2092 | WAKPSGAVGDVAQR | 201-214 for the protein of SEQ No. 425 | 2be |

In the clinical interest column, the entry 2be indicates that all of the CTX-M peptides indicates the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The detection of a mechanism of resistance to ESBL (extended-spectrum beta-lactamase) cephalosporins, induced by the CTX-M protein is characterised by the detection of at least one resistance-marking 2be peptide chosen from the sequences SEQ ID No. 446 to SEQ ID No. 478, SEQ ID No. 480 to SEQ ID No. 495 and SEQ ID No. 2008 to SEQ ID No. 2092.

The detection of a mechanism of resistance to cephalosporins induced by the expression of the SHV protein is characterised by the detection of at least one peptide belonging to the SHV protein and to its different sequence variants SEQ ID No. 496 to SEQ ID No. 613 and SEQ ID No. 1909 to SEQ ID No. 1919.

SEQ ID No. 496:
KRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 497:
LRYIRLCIISLLATLPLAVHASPQPLEQIKLSESQLSGRVGMIEMDLASGRTLTAWRAD

ERFPMMSTFKVVLCGAVLARVDAGDEQLERKIHYRQQDLVDYSPVSEKHLADGMT

VGELCAAAITMSDNSAANLLLATVGGPAGLTAFLRQIGDNVTRLDRWETELNEALPG

DARDTTTPASMAATLRKLLTSQRLSASSQRQLLQWMVDDRVAGPLIRSVLPAGWFI

ADKTGAGERGARGIVALLGPNNKAERIVVIYLRDTPASMAERNQQIAGIGAALIEHW

QR

SEQ ID No. 498:
MRFIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 499:
MRFIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNNAERMVVIYLRDTPASMAERNQQIAGIGAALIEH

WQR

SEQ ID No. 500:
MRFIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 501:
MRIRLCIISLLATLPLAVHASPQPLEQIKLSESQLSGRVGMIEMDLASGRTLTAWRAD

ERFPMMSTFKVVLCGAVLARVDAGDEQLERKIHYRQQDLVDYSPVSEKHLADGMT

VGELCAAAITMSDNSAANLLLATVGGPVGLTAFLRQIGDNVTRLDRWETELNEALPG

DARDTTTPASMAATLRKLLTSQRLSARSQRQLLQWMVDDRVAGPLIRSVLPAGWFI

ADRTGAGERGARGIVALLGPNNKAERIVVIYLRDTPASMAERNQQIAGIGAALIEHW

QR

SEQ ID No. 502:
MRYARLCIISLLATLPLVVHASPQPLEQIKQSESQLSGRVGMIEMDLASGRTLTAWR

ADERFPMMSTFKVVLCGAVLARVDAGDEQLERKIHYRQQDLVDYSPVSEKHLADG

MTVGELCAAAITVSDNSAANLLLATVGGPAGLTAFLRQIGDNVTRLDRWETELNEAL

PGDARDTTTPASMAATLRKLLTSQRLSARSQRQLLQWMVDDRVAGPLIRSVLPAG

WFIADKTGAGERGARGIVALLGPNNKAERIVVIYLRDTPASMAERNQQIAGIGAALIE

HWQR

SEQ ID No. 503:
MRYFRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 504:
MRYFRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPVGLTAFLRQIGDNVTRLDRWETELNEALP

GDARDTTTPASMAATLRKLLTSQRLSARSQRQLLQWMVDDRVAGPLIRSVLPAGW

FIADRTGAGERGARGIVALLGPNNKAERIVVIYLRDTPASMAERNQQIAGIGAALIEH

WQR

SEQ ID No. 505:
MRYFRLCIISLLATLPLAVHASPQPLEQIKLSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 506:
MRYFRLCIISLLATLPLAVHASPQPLEQIKLSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAAKRGARGIVALLGPNNKAERIVVIYLRDTPASMAERNQQIAGIGAALIEH

WQR

SEQ ID No. 507:
MRYFRLCIISLLATLPLAVHASPQPLEQIKLSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 508:
MRYFRLCIISLLATLPLAVHASPQPLEQIKLSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

-continued

SEQ ID No. 509:
MRYFRLCIISLLATLPLAVHASPQPLEQIKLSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 510:
MRYFRLCIISLLATLPLAVHASPQPLEQIKLSESQLSGSVGMIEMDLASGRTLTAWRA

DGRFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 511:
MRYIRLCIISLLAALPLAVHASPQPLEQIKQSESQLSGRVGMIEMDLASGRTLTAWRA

DERFPMISTFKVVLCGAVLARVDAGDEQLERKIHYRQQDLVDYSPVSEKHLADGMT

VGELCAAAITMSDNSAANLLLAIVGGPAGLTAFLRQIGDNVTRLDRWETELNEALPG

DARDTTTPASMAATLRKLLTSQRLSARSQRQLLQWMVDDRVAGPLIRSVLPAGWFI

ADKTGAGERGARGIVALLGPNNKAERIVVIYLRDTPASMAERNQQIAGIGAALIEHW

QR

SEQ ID No. 512:
MRYIRLCIISLLAALPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVEDRVAGPLIRSVLPAGW

FIADKTGAGERGARGIVALLGPNNKAERIVVIYLRDTPASMAERNQQIAGIGAALIEH

WQR

SEQ ID No. 513:
MRYIRLCIISLLAALPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQHIAGIGAALIEH

WQR

SEQ ID No. 514:
MRYIRLCIISLLAALPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 515:
MRYIRLCIISLLATLPLAVHASPQPLDQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 516:
MRYIRLCIISLLATLPLAVHASPQPLEQIKLSESQLSGRVGMIEMDLASGRTLTAWHA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 517:
MRYIRLCIISLLATLPLAVHASPQPLEQIKLSESQLSGRVGMIEMDLASGRTLTAWHA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGKRGARGIVALLGPNNKAERIVVIYLRDTPASMAKRNQQIAGIGAALIEH

WQR

SEQ ID No. 518:
MRYIRLCIISLLATLPLAVHASPQPLEQIKLSESQLSGRVGMIEMDLASGRTLTAWRA

DERFPMISTFKVVLCGAVLARVDAGDEQLERKIHYRQQDLVDYSPVSEKHLADGMT

VGELCAAAITMSDNSAANLLLATVGGPAGLTAFLRQIGDNVTRLDRWETELNEALPG

DARDTTTPASMAATLRKLLTSQRLSARSQRQLLQWMVDDRVAGPLIRSVLPAGWFI

ADKTGAGERGARGIVALLGPNNKAERIVVIYLRDTPASMAERNQQIAGIGAALIEHW

QR

SEQ ID No. 519:
MRYIRLCIISLLATLPLAVHASPQPLEQIKLSESQLSGRVGMIEMDLASGRTLTAWRA

DERFPMMSTFKVVLCGAVLARVDAGDEQLERKIHYLQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 520:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHFADGM

TVGELCAAAITMSDNSAANLLLATVGGPAGLSAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 521:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TIGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 522:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGEFCAAAITMSDNSAANLLLATVGGPAGLTAFLRQIGDNVTRLDRWETELNEAFP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 523:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGEFCAAAITMSDNSAANLLLATVGGPAGLTAFLRQIGDNVTRLDRWETELNEALP

GDARDTTTPASMAGTLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 524:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAAKLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 525:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATFGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 526:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGLAGLTAFLRQIGDNVTRLDRWETELNEALP

ADARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 527:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 528:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 529:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDKVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 530:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETDRWETE

LNEALPGDARDTTTPASMAATLRKLLTSQRLSARSQRQLLQWMVDDRVAGPLIRSV

LPAGWFIADKTGAGERGARGIVALLGPNNKAERIVVIYLRDTPASMAERNQQIAGIG

AALIEHWQR

SEQ ID No. 531:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEAFP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 532:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEAFP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 533:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARATTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 534:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLNSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 535:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARLQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 536:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQLQLLQWMVDDRVAGPLIRSVLPAGW

FIADKTGAGERGARGIVALLGPNNKAERIVVIYLRDTPASMAERNQQIAGIGAALIEH

WQR

SEQ ID No. 537:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQLQLLQWMVDDRVAGPLIRSVLPAGW

FIADKTGASERGARGIVALLGPNNKAERIVVIYLRDTPASMAERNQQIAGIGAALIEH

WQR

SEQ ID No. 538:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQLQLLQWMVDDRVAGPLIRSVLPAGW

FIADKTGASKRGARGIVALLGPNNKAERIVVIYLRDTPASMAERNQQIAGIGAALIEH

WQR

SEQ ID No. 539:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDGVAGPLIRSVLPAGW

FIADKTGAGERGARGIVALLGPNNKAERIVVIYLRDTPASMAERNQQIAGIGAALIEH

WQR

SEQ ID No. 540:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAAERGARGIVALLGPNNKAERIVVIYLRDTPASMAERNQQIAGIGAALIEH

WQR

SEQ ID No. 541:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPDNKAERIVVIYLRDTPASMAERNQQIAGIGAALIEH

WQR

SEQ ID No. 542:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNHKAERIVVIYLRDTPASMAERNQQIAGIGAALIEH

WQR

SEQ ID No. 543:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 544:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALRGPNNKAERIVVIYLRDTPASMAERNQQIAGIGAALIEH

WQR

SEQ ID No. 545:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGKRGARGIVALLGPNNKAERIVVIYLRDSPASMAERNQQIAGIGAALIEH

WQR

SEQ ID No. 546:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGKRGARGIVALLGPNNKAERTVVIYLRDTPASMAERNQQIAGIGAALIEH

WQR

SEQ ID No. 547:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDSPASMAERNQQIAGIGAALIEH

WQR

SEQ ID No. 548:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 549:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 550:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGLGAALIEH

WQR

SEQ ID No. 551:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADRTGAGERGARGIVALLGPNNKAERIVVIYLRDTPASMAERNQQIAGIGAALIEH

WQR

SEQ ID No. 552:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLSAGW

FIADKTGAGERGARGIVALLGPNNKAERIVVIYLRDTPASMAERNQQIAGIGAALIEH

WQR

SEQ ID No. 553:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDGRVAGPLIRSVLPAGW

FIADKTGAGERGARGIVALLGPNNKAERIVVIYLRDTPASMAERNQQIAGIGAALIEH

WQR

SEQ ID No. 554:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRHLLQWMVDDRVAGPLIRSVLPAGW

FIADKTGAGERGARGIVALLGPNNKAERIVVIYLRDTPASMAERNQQIAGIGAALIEH

WQR

SEQ ID No. 555:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 556:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRQLLQWMVDDRVAGPLIRSVLPAGW

FIADKTGAGKRGARGIVALLGPNNKAERIVVIYLRDTPASMAERNQQIAGIGAALIEH

WQR

SEQ ID No. 557:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 558:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARGTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 559:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARNTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 560:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALS

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 561:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETERNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 562:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGENVTRLDRWETELNEALP

GDARDTTTPASMAATLRKLLTNQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 563:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPVGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 564:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSVANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTLASMAERNQQIAGIGAALIEH

WQR

SEQ ID No. 565:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAVITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 566:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCTAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 567:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKYLADGM

TVGELCAAAITMSDNSAANLLLATVGGPVGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 568:
MRYIRLCIISLLATLPLAVHASPQPLEQIKLSESQLSGRVGMIEMDLASRTLTAWRAD

ERFPMMSTFKVVLCGAVLARVDAGDEQLERKIHYRQQDLVDYSPVSEKHLADGMT

VGELCAAAITMGDNSAANLLLRTVGGPAGLTAFLRQIGDNVTRLDRWETELNEALP

GDARDTTTPASMAATLRNVLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 569:
MRYIRLCIISLLATLPLAVHASPQPLEQIKLSESQLSGRVGMIEMDLASRTLTAWRAD
ERFPMMSTFKVVLCGAVLARVDAGDEQLERKIHYRQQDLVDYSPVSEKHLADGMT
VGELCAAAITMSDNSAANLLLRTVGGPAGLTAFLRQIGDNVTRLDRWETELNEALPG
DARDTTTPASMAATLRNVLTSQRLSARSQRQLLQWMVDDRVAGPLIRSVLPAGWFI
ADKTGASKRGARGIVALLGPNNKAERIVVIYLRDTPASMAERNQQIAGIGAALIEHW
QR

SEQ ID No. 570:
MRYIRLCIISLLATLPLAVHASPQPLEQIKLSESQLSGRVGMIEMDLASSRTLTAWRA
DERFPMMSTFKVVLCGAVLARVDAGDEQLERKIHYRQQDLVDYSPVSEKHLADGM
TVGELCAAAITMSDNSAANLLLATVGGPAGLTAFLRQIGDNVTRLDRWETELNEALP
GDARDTTTPASMAATLRKLLTSQRLSARSQRQLLQWMVDDRVAGPLIRSVLPAGW
FIADKTGAGERGARGIVALLGPNNKAERIVVIYLRDTPASMAERNQQIAGIGAALIEH
WQR

SEQ ID No. 571:
MRYIRLCIISLLATLPLAVHASPQPLEQIKQSESQLSGRVGMIEMDLASGRTLTAWCA
DERFPMMSTFKVVLCGAVLARVDAGDEQLERKIHYRQQDLVDYSPVSEKHLADGM
TVGELCAAAITMSDNSAANLLLATVGGPAGLTAFLRQIGDNVTRLDRWETELNEALP
GDARDTTTPASMAATLRKLLTSQRLSARSQRQLLQWMVDDRVAGPLIRSVLPAGW
FIADKTGAGERGARGIVALLGPNNKAERIVVIYLRDTPASMAERNQQIAGIGAALIEH
WQR

SEQ ID No. 572:
MRYIRLCIISLLATLPLAVHASPQPLEQIKQSESQLSGRVGMIEMDLASGRTLTAWRA
DERFPMISTFKVVLCGAVLARVDAGDEQLERKIHYRQQDLVDYSPVSEKHLADGMT
VGELCAAAITMSDNSAANLLLAIVGGPAGLTAFLRQIGDNVTRLDRWETELNEALPG
DARDTTTPASMAATLRKLLTSQRLSARSQRQLLQWMVDDRVAGPLIRSVLPAGWFI
ADKTGAGERGARGIVALLGPNNKAERIVVIYLRDTPASMAERNQQIAGIGAALIEHW
QR

SEQ ID No. 573:
MRYIRLCIISLLATLPLAVHASPQPLEQIKQSESQLSGRVGMIEMDLASGRTLTAWRA
DERFPMMSTFKVALCGAVLARVDAGDEQLERKIHYRQQDLVDYSPVSEKHLADGM
TVGELCAAAITMSDNSAANLLLATVGGPAGLTAFLRQIGDNVTRLDRWETELNEALP
GDARDTTTPASMAATLRKLLTSQRLSARSQRQLLQWMVDDRVAGPLIRSVLPAGW
FIADKTGAGERGARGIVALLGPNNKAERIVVIYLRDTPASMAERNQQIAGIGAALIEH
WQR

SEQ ID No. 574:
MRYIRLCIISLLATLPLAVHASPQPLEQIKQSESQLSGRVGMIEMDLASGRTLTAWRA
DERFPMMSTFKVLLCGAVLARVDAGDEQLERKIHYRQQDLVDYSPVSEKHLADGM
TVGELCAAAITMSDNSAANLLLATVGGPAGLTAFLRQIGDNVTRLDRWETELNEALP
GDARDTTTPASMAATLRKLLTSQRLSARSQRQLLQWMVDDRVAGPLIRSVLPAGW
FIADKTGASKRGARGIVALLGPNNKAERIVVIYLRDTPASMAERNQQIAGIGAALIEH
WQR

SEQ ID No. 575:
MRYIRLCIISLLATLPLAVHASPQPLEQIKQSESQLSGRVGMIEMDLASGRTLTAWRA

DERFPMMSTFKVVLCGAMLARVDAGDKQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 576:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLAIVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 577:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 578:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLISQRLSARSQRQLLQWMVDDRVAGPLIRSVLPAGWF

IADKTGAGERGARGIVALLGPNNKAERIVVIYLRDTPASMAERNQQIAGIGAALIEHW

QR

SEQ ID No. 579:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDARVAGPLIRSVLPAGW

FIADKTGAGERGARGIVALLGPNNKAERIVVIYLRDTPASMAERNQQIAGIGAALIEH

WQR

SEQ ID No. 580:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKAGAGERGARGIVALLGPNNKAERIVVIYLRDTPASMAERNQQIAGIGAALIEH

WQR

SEQ ID No. 581:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAAERGARGIVALLGPNNKAERIVVIYLRDTPASMAERNQQIAGIGAALIEH

WQR

SEQ ID No. 582:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 583:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGGRGIVALLGPNNKAERIVVIYLRDTPASMAERNQQIAGIGAALIEH

WQR

SEQ ID No. 584:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGKRGARGIVALLGPNNKAERIVVIYLRDTPASMAERNQQIAGIGAALIEH

WQR

SEQ ID No. 585:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASERGARGIVALLGPNNKAERIVVIYLRDTPASMAERNQQIAGIGAALIEH

WQR

SEQ ID No. 586:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGGNIKAERIVVIYLRDTPASMAERNQQIAGIGAALIEHW

QR

SEQ ID No. 587:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAELDQQIAGIGAALIEHW

QR

SEQ ID No. 588:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 589:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASRRGARGIVALLGPNNKAERIVVIYLRDTPASMAERNQQIAGIGAALIEH

WQR

SEQ ID No. 590:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADRTGAGERGARGIVALLGPNNKAERIVVIYLRDTPASMAERNQQIAGIGAALIEH

WQR

SEQ ID No. 591:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 592:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEVLP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 593:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGVTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 594:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPTGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 595:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGSPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 596:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 597:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLTDGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 598:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKYLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

-continued

SEQ ID No. 599:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQHLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 600:
MRYIRLCIISLLATLPLAVHASPQPLEQIKQSESQLSGRVGMIEMDLASGRTLTAWRA

DERFPMMSTFKVVLCGAVLARVDAGDKQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGGRGIVALLGPNNKAERIVVIYLRDTPASMAERNQQIAGIGAALIEH

WQR

SEQ ID No. 601:
MRYIRLCIISLLATLPLAVHASPQPLEQIKQSESQLSGRVGMIEMDLASGRTLTAWRA

DERFPMMSTFKVVLCGTVLARVDAGDEQLERKIHYRQQDLVDYSPVSEKHLADGM

TVGELCAAAITMSDNSAANLLLATVGGPAGLTAFLRQIDDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 602:
MRYIRLCIISLLATLPLAVHASPQPLEQIKQSESQLSGRVGMIEMDLASGRTLTAWRA

DQRFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 603:
MRYIRLCIISLLATLPLAVHASPQPLEQIKQSESQLSGSVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAAERGARGIVALLGPNNKAERIVVIYLRDTPASMAERNQQIAGIGAALIEH

WQR

SEQ ID No. 604:
MRYIRLCIISLLATLPLAVHSSPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 605:
MRYIRLCIISLLATLPLTVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 606:
MRYIRLCIISLLATLSLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGKRGARGIVALLGPNNKAERIVVIYLRDTPASMAERNQQIAGIGAALIEH

WQR

SEQ ID No. 607:
MRYIRLCIISLLATMPLAVHASPQPLEQIKQSESQLSGRVGMIEMDLASGRTLTAWR

ADERFPMMSTFKVVLCGAVLARVDAGDEQLERKIHYRQQDLVDYSPVSEKHLADG

MTVGELCAAAITMSDNSAANLLLATVGGPAGLTAFLRQIGDNVTRLDRWETELNEAL

PGDARDTTTPASMAATLRKLLTSQRLSARSQRQLLQWMVDDRVAGPLIRSVLPAG

WFIADKTGAGERGARGIVALLGPNNKAERIVVIYLRDTPASMAERNQQIAGIGAALIE

HWQR

SEQ ID No. 608:
MRYIRLCIISLLAVLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 609:
MRYIRLNIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 610:
MRYIRRCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDMPASMAERNQQIAGIGAALIEH

WQR

-continued

SEQ ID No. 611:
MRYIRRCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 612:
MRYVRLCIISLLATLPLAVHASPQPLEQIKQSESQLSGRVGMIEMDLASGRTLTAWR

ADERFPMMSTFKVVLCGAVLARVDAGDEQLERKIHYRQQDLVDYSPVSEKHLADG

MTVGELCAAAITMSDNSAANLLLATVGGPAGLTAFLRQIGDNVTRLDRWETELNEAL

PGDARDTTTPASMAATLRKLLTSQRLSARSQRQLLQWMVDDRVAGPLIRSVLPAG

WFIADKTGAGERGARGIVALLGPNNKAERIVVIYLRDTPASMAERNQQIAGIGAALIE

HWQR

SEQ ID No. 613:
MRYVRLCIISLLATLPLAVHTSPQPLEQIKQSESQLSGRVGMIEMDLASGRTLTAWR

ADERFPMMSTFKVVLCGAVLARVDAGDEQLERKIHYRQQDLVDYSPVSEKHLADG

MTVGELCAAAITMSDNSAANLLLATVGGPAGLTAFLRQIGDNVTRLDRWETELNEAL

PGDARDTTTPASMAATLRKLLTSQRLSARSQRQLLQWMVDDRVAGPLIRSVLPAG

WFIADKTGAGERGARGIVALLGPNNKAERIVVIYLRDTPASMAERNQQIAGIGAALIE

HWQR

SEQ ID No. 1909:
MRYIRLCIISLLAALPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQHIAGIGAALIEH

WQR

SEQ ID No. 1910:
ALPGDARDTTTPASMAATLRKLLTSQRLSARSQRQLLQWMVDDRVAGPLIRSVLPA

GWFIADKTGASERGARGIVALLGPNNKAERIVVIYLRDS

SEQ ID No. 1911:
MRYIRLCIISLLAALPLVVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITVSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 1912:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

-continued

FIADKTGASKRGARGIVALLGPNNKAERIVVIYLRDTPASMAELDQQIAGIGAALIEHW

QR

SEQ ID No. 1913:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELRAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGTGAAPIEH

WQR

SEQ ID No. 1914:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLREIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

SEQ ID No. 1915:
MRYIRLCIISLLATLPLAVHASPQPLKQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMTATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 1916:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAALTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPHNKAERIVVIYLRDTPASMAERNQQIAGIGAALIEH

WQR

SEQ ID No. 1917:
KRYIRLCIISLLATLPLAVHASPQPLEQIKLSESQLSGRVGMIEMDLASGRTLTAWRA

DERFPMMSTFKVVLCGAVLARVDAGDEQLERKIHYSQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGAGERGARGIVALLGPNNKAERIVVIYLRDTPASMAERNQQIAGIGAALIEH

WQR

SEQ ID No. 1918:
MRYIRLCIISLLATLPLAVHASPQPLEQIKLSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAALIEH

WQR

-continued

SEQ ID No. 1919:
MRYIRLCIISLLATLPLAVHASPQPLEQIKQSESQLSGRVGMIEMDLASGRTLTAWRA

DERFPMMSTFKVVLCGAVLARVDAGDEQLERKIHYRQQDLVDYSPVSEKHLADGM

TVGELCAAAITMSDNSAANLLLATVGGPAGLTAFLRQIGDNVTRLDRWETELNEALP

GDARDTTTPASMAATLRKLLTSQRLSARSQRQLLQWMVDDRVAGPLIRSVLPAGW

FIADKTGASKRGARGIVALLGPNNKAERIVVIYLRDTPASMAERNQQIAGIGAA said peptides being chosen, preferably, from the peptides of sequence SEQ ID No. 614 to SEQ ID No. 711 and SEQ ID No. 2093 to SEQ ID No. 2096 as defined hereafter:

| Peptide SEQ ID No. | Amino acid sequence | Position of the peptide in the SHV protein | Clinical interest |
|---|---|---|---|
| SEQ ID No. 614 | AGAGER | 231-236 for the protein of SEQ No. 580 | SHV |
| SEQ ID No. 615 | ATTTPASMAATLR | 175-187 for the protein of SEQ No. 533 | 2be |
| SEQ ID No. 616 | CIISLLATLPLAVH ASPQPLEQIK | 7-30 for the proteins of SEQ No. 496, 497, 498, 499, 500, 503, 504, 505, 506, 507, 508, 509, 510, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 610, 611, 612, 1913, 1914, 1915, 1917, 1918, 1919, 1920; 6-29 for the protein of sequence SEQ ID No. 501 | SHV |
| SEQ ID No. 617 | DMPASMAER | 261-269 for the protein of SEQ No. 610 | 2b |
| SEQ ID No. 618 | DSPASMAER | 261-269 for the proteins of SEQ No. 545, 547 | SHV |
| SEQ ID No. 619 | DTLASMAER | 261-269 for the protein of SEQ No. 564 | SHV |
| SEQ ID No. 620 | DTPASMAER | 261-269 for the proteins of SEQ No. 496, 497, 498, 499, 500, 502, 503, 504, 505, 506, 507, 508, 509, 510, 511, 512, 513, 514, 515, 516, 518, 519, 520, 521, 522, 523, 524, 525, 526, 527, 528, 529, 531, 532, 533, 534, 535, 536, 537, 538, 539, 540, 541, 542, 543, 544, 546, 548, 549, 550, 551, 552, 553, 554, 555, 556, 557, 558, 559, 560, 561, 562, 563, 565, 566, 567, 570, 571, 572, 573, 574, 575, 576, 577, 578, 579, 580, 581, 582, 583, 584, 585, 586, 588, 589, 590, 591, 592, 593, 594, 595, 596, 597, 598, 599, 600, 601, 602, 603, 604, 605, 606, 607, 608, 609, 611, 612, 613, 1910, 1912, 1914, 1915, 1916, 1917, 1918, 1919, 1920; 260-268 for the protein of sequence SEQ ID No. 501; 266-274 for the protein of sequence SEQ ID No. 530; 260-268 for the protein of sequence SEQ ID No. 568; 260-268 for the protein of sequence SEQ ID No. 569 | SHV |
| SEQ ID No. 621 | DTPASMAK | 261-268 for the protein of SEQ No. 517 | SHV |
| SEQ ID No. 622 | DTTTPASMAATLR | 175-187 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 524, 525, 526, 527, 528, 529, 531, 532, 534, 535, 536, 537, 538, 539, 540, 541, 542, 543, 544, 545, 546, 547, 548, 549, 550, 551, 552, 553, 560, 561, 562, 563, 564, 565, 566, 567, 570, 571, 572, 573, 574, 575, 576, 577, 578, 579, 580, 581, 582, 583, 584, 585, 586, 587, 588, 589, 590, 592, 593, 594, 595, 596, 597, 598, 599, 600, 601, 602, 603, 604, 605, 606, 607, 608, 609, 610, 611, 612, 613, 1910, 1912, 1913, 1914, 1915, 1917, 1918, | SHV |

| Peptide SEQ ID No. | Amino acid sequence | Position of the peptide in the SHV protein | Clinical interest |
|---|---|---|---|
| | | 1919, 1920; 174-186 for the protein of sequence SEQ ID No. 501; 180-192 for the protein of SEQ ID No. 530; 174-186 for the protein of sequence SEQ ID No. 568; 174-186 for the protein of sequence SEQ ID No. 569; 8-20 for the protein of sequence SEQ ID No. 1911 | |
| SEQ ID No. 623 | DTTTPASMAGTLR | 175-187 for the protein of SEQ No. 523 | 2b |
| SEQ ID No. 624 | DTTTPASMTATLR | 175-187 for the proteins of SEQ No. 554, 555, 556, 557, 591, 1916 | SHV |
| SEQ ID No. 625 | FPMISTFK | 62-69 for the proteins of SEQ No. 511, 518, 572 | 2br |
| SEQ ID No. 626 | FPMMSTFK | 62-69 for the proteins of SEQ No. 496, 497, 498, 499, 500, 502, 503, 504, 505, 506, 507, 508, 509, 510, 512, 513, 514, 515, 516, 517, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 570, 571, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 61-68 for the protein of sequence SEQ ID No. 501; 61-68 for the protein of sequence SEQ ID No. 568; 61-68 for the protein of sequence SEQ ID No. 569 | SHV |
| SEQ ID No. 627 | GIVALLGGNIK | 240-250 for the protein of SEQ No. 586 | 2b |
| SEQ ID No. 628 | GIVALLGPDNK | 240-250 for the protein of SEQ No. 541 | SHV |
| SEQ ID No. 629 | GIVALLGPNHK | 240-250 for the protein of SEQ No. 542 | SHV |
| SEQ ID No. 630 | GIVALLGPNNK | 240-250 for the proteins of SEQ No. 496, 497, 498, 500, 502, 503, 504, 505, 506, 507, 508, 509, 510, 511, 512, 513, 514, 515, 516, 517, 518, 519, 520, 521, 522, 523, 524, 525, 526, 527, 528, 529, 531, 532, 533, 534, 535, 536, 537, 538, 539, 540, 543, 545, 546, 547, 548, 549, 550, 551, 552, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1918, 1919, 1920; 239-249 for the protein of sequence SEQ ID No. 501; 245-255 for the protein of sequence SEQ ID No. 530; 239-249 for the protein of sequence SEQ ID No. 568; 239-249 for the protein of sequence SEQ ID No. 569; 73-83 for the protein of sequence SEQ ID No. 1911 | SHV |
| SEQ ID No. 631 | GIVALLGPNNNAER | 240-253 for the protein of SEQ No. 499 | 2b |
| SEQ ID No. 632 | GIVALR | 240-245 for the protein of SEQ No. 544 | SHV |
| SEQ ID No. 633 | GPNNK | 246-250 for the proteins of SEQ No. 496, 497, 498, 500, 502, 503, 504, 505, 506, 507, 508, 509, 510, 511, 512, 513, 514, 515, 516, 517, 518, 519, 520, 521, 522, 523, 524, 525, 526, 527, 528, 529, 531, 532, 533, 534, 535, 536, 537, 538, 539, 540, 543, 544, 545, 546, 547, 548, 549, 550, 551, 552, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, | SHV |

-continued

| Peptide SEQ ID No. | Amino acid sequence | Position of the peptide in the SHV protein | Clinical interest |
|---|---|---|---|
| | | 1914, 1915, 1916, 1918, 1919, 1920; 245-249 for the protein of sequence SEQ ID No. 501; 251-255 for the protein of sequence SEQ ID No. 530; 245-249 for the protein of sequence SEQ ID No. 568; 245-249 for the protein of sequence SEQ ID No. 569; 79-83 for the protein of sequence SEQ ID No. 1911 | |
| SEQ ID No. 634 | GTTTPASMAATLR | 175-187 for the protein of SEQ No. 558 | 2be |
| SEQ ID No. 635 | HLADGMTVGELCAAAITMSDNSAAK | 108-132 for the protein of SEQ No. 524 | SHV |
| SEQ ID No. 636 | HLLQWMVDDR | 202-211 for the protein of SEQ No. 554 | SHV |
| SEQ ID No. 637 | IHYLQQDLVDYSPVSEK | 91-107 for the protein of SEQ No. 519 | SHV |
| SEQ ID No. 638 | IVVIYLR | 254-260 for the proteins of SEQ No. 496, 497, 498, 500, 502, 503, 504, 505, 506, 507, 508, 509, 510, 511, 512, 513, 514, 515, 516, 517, 518, 519, 520, 521, 522, 523, 524, 525, 526, 527, 528, 529, 531, 532, 533, 534, 535, 536, 537, 538, 539, 540, 541, 542, 543, 544, 545, 547, 548, 549, 550, 551, 552, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 253-259 for the protein of sequence SEQ ID No. 501; 259-265 for the protein of sequence SEQ ID No. 530; 253-259 for the protein of sequence SEQ ID No. 568; 253-259 for the protein of sequence SEQ ID No. 569; 87-93 for the protein of sequence SEQ ID No. 1911 | SHV |
| SEQ ID No. 639 | LCIISLLAALPLAVHASPQPLEQIK | 6-30 for the proteins of SEQ No. 511, 512, 513, 514, 1910 | 2b |
| SEQ ID No. 640 | LCIISLLATLPLAVHASPQPLDQIK | 6-30 for the protein of SEQ No. 515 | 2b |
| SEQ ID No. 641 | LCIISLLATLPLAVHASPQPLEQIK | 6-30 for the proteins of SEQ No. 496, 497, 498, 499, 500, 503, 504, 505, 506, 507, 508, 509, 510, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 612, 1913, 1914, 1915, 1917, 1918, 1919, 1920; 5-29 for the protein of sequence SEQ ID No. 501 | SHV |
| SEQ ID No. 642 | LCIISLLATLPLAVHSSPQPLEQIK | 6-30 for the protein of SEQ No. 604 | SHV |
| SEQ ID No. 643 | LCIISLLATLPLAVHTSPQPLEQIK | 6-30 for the protein of SEQ No. 613 | SHV |
| SEQ ID No. 644 | LCIISLLATLPLTVHASPQPLEQIK | 6-30 for the protein of SEQ No. 605 | 2b |
| SEQ ID No. 645 | LCIISLLATLPLVVHASPQPLEQIK | 6-30 for the protein of SEQ No. 502 | 2b |
| SEQ ID No. 646 | LCIISLLATLSLAVHASPQPLEQIK | 6-30 for the protein of SEQ No. 606 | 2be |
| SEQ ID No. 647 | LCIISLLATMPLAVHASPQPLEQIK | 6-30 for the protein of SEQ No. 607 | SHV |
| SEQ ID No. 648 | LCIISLLAVLPLAVHASPQPLEQIK | 6-30 for the protein of SEQ No. 608 | 2b |

| Peptide SEQ ID No. | Amino acid sequence | Position of the peptide in the SHV protein | Clinical interest |
|---|---|---|---|
| SEQ ID No. 649 | LLISQR | 189-194 for the protein of SEQ No. 578 | SHV |
| SEQ ID No. 650 | LLLATVGGPAGLTAFLR | 133-149 for the proteins of SEQ No. 496, 497, 498, 499, 500, 502, 503, 505, 506, 507, 508, 509, 510, 512, 513, 514, 515, 516, 517, 518, 519, 521, 522, 523, 524, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 564, 565, 566, 570, 571, 573, 574, 575, 577, 578, 579, 580, 581, 582, 583, 584, 585, 586, 587, 588, 589, 590, 591, 592, 596, 597, 598, 599, 600, 601, 602, 603, 604, 605, 606, 607, 608, 609, 610, 611, 612, 613, 1910, 1912, 1913, 1914, 1915, 1916, 1918, 1919, 1920 | SHV |
| SEQ ID No. 651 | LLNSQR | 189-194 for the protein of SEQ No. 534 | 2be |
| SEQ ID No. 652 | LLTNQR | 189-194 for the protein of SEQ No. 562 | SHV |
| SEQ ID No. 653 | LLTSQR | 189-194 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, 526, 527, 528, 529, 531, 532, 533, 535, 536, 537, 538, 539, 540, 541, 542, 543, 544, 545, 546, 547, 548, 549, 550, 551, 552, 553, 554, 555, 556, 557, 558, 559, 560, 561, 563, 564, 565, 566, 567, 570, 571, 572, 573, 574, 575, 576, 577, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 188-193 for the protein of sequence SEQ ID No. 501; 194-199 for the protein of sequence SEQ ID No. 530; 22-27 for the protein of sequence SEQ ID No. 1911 | SHV |
| SEQ ID No. 654 | LNIISLLATLPLAVHASPQPLEQIK | 6-30 for the protein of SEQ No. 609 | 2b |
| SEQ ID No. 655 | LSASSQR | 195-201 for the protein of SEQ No. 497 | SHV |
| SEQ ID No. 656 | LSESQLSGR | 31-39 for the proteins of SEQ No. 496, 497, 498, 499, 500, 503, 504, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 604, 606, 609, 1917, 1918, 1919; 30-38 for the protein of sequence SEQ ID No. 501 | SHV |
| SEQ ID No. 657 | LSESQLSGSVGMIEMDLASGR | 31-51 for the proteins of SEQ No. 505, 506, 507, 508, 509, 510 | SHV |
| SEQ ID No. 658 | MVVIYLR | 254-260 for the protein of SEQ No. 499 | 2b |
| SEQ ID No. 659 | NEALPGDAR | 166-174 for the proteins of SEQ No. 496, 497, 498, 499, 500, 502, 503, 504, 505, 506, 507, 508, 509, 510, 511, 512, 513, 514, 515, 516, 517, 518, 519, 520, 521, 523, 524, 525, 527, 528, 529, 533, 534, 535, 536, 537, 538, 539, 540, 541, 542, 543, 544, 545, 546, 547, 548, 549, 550, 551, 552, 553, 554, 555, 556, 557, 558, 559, 561, 562, 563, 564, 565, 566, 567, 570, 571, 572, 573, 574, 575, 576, 577, 578, 579, 580, 581, 582, 583, 584, 585, 586, 587, 588, 589, 590, 591, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 165-173 for the protein of sequence SEQ ID No. 501; 171-179 for the protein of sequence SEQ ID No. 530; 165-173 for the protein of sequence SEQ ID No. 568; 165-173 for the protein of sequence SEQ ID No. 569 | 2be |
| SEQ ID No. 660 | NQHIAGIGAALIEHWQR | 270-286 for the proteins of SEQ No. 513, 1910 | SHV |

-continued

| Peptide SEQ ID No. | Amino acid sequence | Position of the peptide in the SHV protein | Clinical interest |
|---|---|---|---|
| SEQ ID No. 661 | NQQIAGIGAALIE HWQR | 270-286 for the proteins of SEQ No. 496, 497, 498, 499, 500, 502, 503, 504, 505, 506, 507, 508, 509, 510, 511, 512, 514, 515, 516, 517, 518, 519, 520, 521, 522, 523, 524, 525, 526, 527, 528, 529, 531, 532, 533, 534, 535, 536, 537, 538, 539, 540, 541, 542, 543, 544, 545, 546, 547, 548, 549, 551, 552, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 586, 588, 589, 590, 591, 592, 593, 594, 595, 596, 597, 598, 599, 600, 601, 602, 603, 604, 605, 606, 607, 608, 609, 610, 611, 612, 613, 1912, 1915, 1916, 1917, 1918, 1919; 269-285 for the protein of sequence SEQ ID No. 501; 275-291 for the protein of sequence SEQ ID No. 530; 269-285 for the protein of sequence SEQ ID No. 568; 269-285 for the protein of sequence SEQ ID No. 569 | SHV |
| SEQ ID No. 662 | NQQIAGLGAALIE HWQR | 270-286 for the protein of SEQ No. 550 | SHV |
| SEQ ID No. 663 | NTTTPASMAATLR | 175-187 for the protein of SEQ No. 559 | 2be |
| SEQ ID No. 664 | NVLTSQR | 187-193 for the proteins of SEQ No. 568, 569 | SHV |
| SEQ ID No. 665 | QIDDNVTR | 150-157 for the proteins of SEQ No. 505, 527, 528, 565, 577, 601 | 2be |
| SEQ ID No. 666 | QIGDK | 150-154 for the protein of SEQ No. 529 | 2b |
| SEQ ID No. 667 | QIGDNVTR | 150-157 for the proteins of SEQ No. 496, 497, 498, 499, 500, 502, 503, 504, 506, 507, 508, 509, 510, 511, 512, 513, 514, 515, 516, 517, 518, 519, 520, 521, 522, 523, 524, 525, 526, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 563, 564, 566, 567, 570, 571, 572, 573, 574, 575, 576, 578, 579, 580, 581, 582, 583, 584, 585, 586, 587, 588, 589, 590, 591, 592, 593, 594, 595, 596, 597, 598, 599, 600, 602, 603, 604, 605, 606, 607, 608, 609, 610, 611, 612, 613, 1910, 1912, 1913, 1914, 1916, 1917, 1918, 1919, 1920; 149-156 for the protein of sequence SEQ ID No. 501; 149-156 for the protein of sequence SEQ ID No. 568; 149-156 for the protein of sequence SEQ ID No. 569 | SHV |
| SEQ ID No. 668 | QIGENVTR | 150-157 for the protein of SEQ No. 562 | 2b |
| SEQ ID No. 669 | QLLQWMVDAR | 202-211 for the protein of SEQ No. 579 | SHV |
| SEQ ID No. 670 | QLLQWMVDDGV AGPLIR | 202-218 for the protein of SEQ No. 539 | SHV |
| SEQ ID No. 671 | QLLQWMVDDR | 202-211 for the proteins of SEQ No. 496, 497, 498, 499, 500, 502, 503, 504, 505, 506, 507, 508, 509, 510, 511, 513, 514, 515, 516, 517, 518, 519, 520, 521, 522, 523, 524, 525, 526, 527, 528, 529, 531, 532, 533, 534, 535, 536, 537, 538, 540, 541, 542, 543, 544, 545, 546, 547, 548, 549, 550, 551, 552, 555, 556, 557, 558, 559, 560, 561, 562, 563, 564, 565, 566, 567, 570, 571, 572, 573, 574, 575, 576, 577, 578, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 201-210 for the protein of sequence SEQ ID No. 501; 207-216 for the protein of sequence SEQ ID No. 530; 201-210 for the protein of sequence SEQ ID No. 568; 201-210 for the protein of sequence SEQ ID No. 569; 35-44 for the protein of sequence SEQ ID No. 1911 | SHV |
| SEQ ID No. 672 | QLLQWMVDGR | 202-211 for the protein of SEQ No. 553 | 2b |
| SEQ ID No. 673 | QLLQWMVEDR | 202-211 for the protein of SEQ No. 512 | SHV |

-continued

| Peptide SEQ ID No. | Amino acid sequence | Position of the peptide in the SHV protein | Clinical interest |
|---|---|---|---|
| SEQ ID No. 674 | QQDLVDYSPVSEK | 95-107 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 586, 587, 588, 589, 590, 591, 592, 593, 594, 595, 596, 597, 598, 600, 601, 602, 603, 604, 605, 606, 607, 608, 609, 610, 611, 612, 613, 1910, 1912, 1913, 1914, 1915, 1916, 1917, 1918, 1919, 1920; 94-106 for the protein of sequence SEQ ID No. 501; 94-106 for the protein of sequence SEQ ID No. 568; 94-106 for the protein of sequence SEQ ID No. 569 | SHV |
| SEQ ID No. 675 | QQHLVDYSPVSEK | 95-107 for the protein of SEQ No. 599 | 2b |
| SEQ ID No. 676 | QSESQLSGR | 31-39 for the proteins of SEQ No. 502, 511, 512, 513, 514, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 605, 607, 608, 610, 611, 612, 613, 1910, 1912, 1913, 1914, 1915, 1916, 1920 | SHV |
| SEQ ID No. 677 | QSESQLSGSVGMIEMDLASGR | 31-51 for the protein of SEQ No. 603 | 2b |
| SEQ ID No. 678 | SQLQLLQWMVDDR | 199-211 for the proteins of SEQ No. 536, 537, 538 | 2be |
| SEQ ID No. 679 | SVLPAGWFIADK | 219-230 for the proteins of SEQ No. 496, 497, 498, 499, 500, 502, 503, 505, 506, 507, 508, 509, 510, 511, 512, 513, 514, 515, 516, 517, 518, 519, 520, 521, 522, 523, 524, 525, 526, 527, 528, 529, 531, 532, 533, 534, 535, 536, 537, 538, 539, 540, 541, 542, 543, 544, 545, 546, 547, 548, 549, 550, 553, 554, 555, 556, 557, 558, 559, 560, 561, 562, 563, 564, 565, 566, 567, 570, 571, 572, 573, 574, 575, 576, 577, 578, 579, 580, 581, 582, 583, 584, 585, 586, 587, 588, 589, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 224-235 for the protein of sequence SEQ ID No. 530; 218-229 for the protein of sequence SEQ ID No. 568; 218-229 for the protein of sequence SEQ ID No. 569; 52-63 for the protein of sequence SEQ ID No. 1911 | SHV |
| SEQ ID No. 680 | SVLPAGWFIADR | 219-230 for the proteins of SEQ No. 504, 551, 590; 218-229 for the protein of sequence SEQ ID No. 501 | SHV |
| SEQ ID No. 681 | SVLSAGWFIADK | 219-230 for the protein of SEQ No. 552 | 2b |
| SEQ ID No. 682 | TGAAER | 231-236 for the proteins of SEQ No. 540, 581, 603 | SHV |
| SEQ ID No. 683 | TGAAK | 231-235 for the protein of SEQ No. 506 | 2be |
| SEQ ID No. 684 | TGAGER | 231-236 for the proteins of SEQ No. 496, 497, 498, 499, 502, 504, 507, 511, 512, 513, 514, 516, 518, 519, 520, 521, 524, 525, 526, 527, 531, 533, 535, 536, 539, 541, 542, 543, 544, 551, 552, 553, 554, 555, 558, 559, 560, 561, 562, 563, 564, 565, 566, 567, 570, 571, 572, 573, 576, 577, 578, 579, 582, 583, 590, 591, 592, 593, 594, 595, 596, 597, 598, 599, 600, 601, 604, 605, 607, 608, 609, 610, 611, 612, 613, 1910, 1912, 1916, 1917, 1918; 230-235 for the protein of sequence SEQ ID No. 501; 236-241 for the protein of sequence SEQ ID No. 530 | SHV |
| SEQ ID No. 685 | TGAGK | 231-235 for the proteins of SEQ No. 517, 545, 546, 556, 584, 606 | SHV |
| SEQ ID No. 686 | TGASER | 64-69 for the proteins of SEQ No. 1911; 231-236 for the protein of sequence SEQ ID No. 503; 231-236 for the protein of sequence SEQ ID No. 508; 231-236 for the protein of sequence | 2be |

| Peptide SEQ ID No. | Amino acid sequence | Position of the peptide in the SHV protein | Clinical interest |
|---|---|---|---|
| | | SEQ ID No. 522; 231-236 for the protein of sequence SEQ ID No. 532; 231-236 for the protein of sequence SEQ ID No. 537; 231-236 for the protein of sequence SEQ ID No. 547; 231-236 for the protein of sequence SEQ ID No. 548; 231-236 for the protein of sequence SEQ ID No. 585 | |
| SEQ ID No. 687 | TGASK | 231-235 for the proteins of SEQ No. 500, 505, 509, 515, 523, 528, 529, 534, 538, 549, 550, 557, 574, 575, 586, 587, 588, 602, 1913, 1914, 1915, 1919, 1920; 230-234 for the protein of sequence SEQ ID No. 568; 230-234 for the protein of sequence SEQ ID No. 569 | SHV |
| SEQ ID No. 688 | TGASR | 231-235 for the protein of SEQ No. 589 | SHV |
| SEQ ID No. 689 | TLTAWCADER | 52-61 for the protein of SEQ No. 571 | SHV |
| SEQ ID No. 690 | TLTAWHADER | 52-61 for the proteins of SEQ No. 516, 517 | 2be |
| SEQ ID No. 691 | TLTAWR | 52-57 for the proteins of SEQ No. 496, 497, 498, 499, 500, 502, 503, 504, 505, 506, 507, 508, 509, 510, 511, 512, 513, 514, 515, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 570, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 51-56 for the protein of sequence SEQ ID No. 501; 51-56 for the protein of sequence SEQ ID No. 568; 51-56 for the protein of sequence SEQ ID No. 569 | SHV |
| SEQ ID No. 692 | TVGGPAGLTAFLR | 137-149 for the proteins of SEQ No. 496, 497, 498, 499, 500, 502, 503, 505, 506, 507, 508, 509, 510, 512, 513, 514, 515, 516, 517, 518, 519, 521, 522, 523, 524, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 564, 565, 566, 570, 571, 573, 574, 575, 577, 578, 579, 580, 581, 582, 583, 584, 585, 586, 587, 588, 589, 590, 591, 592, 596, 597, 598, 599, 600, 601, 602, 603, 604, 605, 606, 607, 608, 609, 610, 611, 612, 613, 1910, 1912, 1913, 1914, 1915, 1916, 1918, 1919, 1920; 136-148 for the protein of sequence SEQ ID No. 568; 136-148 for the protein of sequence SEQ ID No. 569 | SHV |
| SEQ ID No. 693 | TVVIYLR | 254-260 for the protein of SEQ No. 546 | SHV |
| SEQ ID No. 694 | VAGPLIR | 212-218 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, 526, 527, 528, 529, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 211-217 for the protein of sequence SEQ ID No. 501; 217-223 for the protein of sequence SEQ ID No. 530; 211-217 for the protein of sequence SEQ ID No. 568; 211-217 for the protein of sequence SEQ ID No. 569; 45-51 for the protein of sequence SEQ ID No. 1911 | SHV |
| SEQ ID No. 695 | VALCGAVLAR | 70-79 for the protein of SEQ No. 573 | 2b |
| SEQ ID No. 696 | VDAGDEQLER | 80-89 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, | SHV |

-continued

| Peptide SEQ ID No. | Amino acid sequence | Position of the peptide in the SHV protein | Clinical interest |
|---|---|---|---|
| | | 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 570, 571, 572, 573, 574, 576, 577, 578, 579, 580, 581, 582, 583, 584, 585, 586, 587, 588, 589, 590, 591, 592, 593, 594, 595, 596, 597, 598, 599, 601, 602, 603, 604, 605, 606, 607, 608, 609, 610, 611, 612, 613, 1910, 1912, 1913, 1914, 1915, 1916, 1917, 1918, 1919, 1920; 79-88 for the protein of sequence SEQ ID No. 501; 79-88 for the protein of sequence SEQ ID No. 568; 79-88 for the protein of sequence SEQ ID No. 569 | |
| SEQ ID No. 697 | VDAGDK | 80-85 for the proteins of SEQ No. 575, 600 | SHV |
| SEQ ID No. 698 | VGMIEMDLASGR | 40-51 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 39-50 for the protein of sequence SEQ ID No. 501 | SHV |
| SEQ ID No. 699 | VGMIEMDLASR | 40-50 for the proteins of SEQ No. 568, 569 | SHV |
| SEQ ID No. 700 | VGMIEMDLASSR | 40-51 for the protein of SEQ No. 570 | SHV |
| SEQ ID No. 701 | VLLCGAVLAR | 70-79 for the protein of SEQ No. 574 | SHV |
| SEQ ID No. 702 | VVLCGAMLAR | 70-79 for the protein of SEQ No. 575 | 2be |
| SEQ ID No. 703 | VVLCGAVLAR | 70-79 for the proteins of SEQ No. 496, 497, 498, 499, 500, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 570, 571, 572, 576, 577, 578, 579, 580, 581, 582, 583, 584, 585, 586, 587, 588, 589, 590, 591, 592, 593, 594, 595, 596, 597, 598, 599, 600, 602, 603, 604, 605, 606, 607, 608, 609, 610, 611, 612, 613, 1910, 1912, 1913, 1914, 1915, 1916, 1917, 1918, 1919, 1920; 69-78 for the protein of sequence SEQ ID No. 501; 69-78 for the protein of sequence SEQ ID No. 568; 69-78 for the protein of sequence SEQ ID No. 569 | SHV |
| SEQ ID No. 704 | VVLCGTVLAR | 70-79 for the protein of SEQ No. 601 | 2b |
| SEQ ID No. 705 | WETDR | 161-165 for the protein of SEQ No. 530 | 2be |
| SEQ ID No. 706 | WETELNEAFPGDAR | 161-174 for the proteins of SEQ No. 522, 531, 532 | SHV |
| SEQ ID No. 707 | WETELNEALPADAR | 161-174 for the protein of SEQ No. 526 | 2b |
| SEQ ID No. 708 | WETELNEALPGDAR | 161-174 for the proteins of SEQ No. 496, 497, 498, 499, 500, 502, 503, 504, 505, 506, 507, 508, 509, 510, 511, 512, 513, 514, 515, 516, 517, 518, 519, 520, 521, 523, 524, 525, 527, 528, 529, 533, 534, 535, 536, 537, 538, 539, 540, 541, 542, 543, 544, 545, 546, 547, 548, 549, 550, 551, 552, 553, 554, 555, 556, 557, 558, 559, 562, 563, 564, 565, 566, 567, 570, 571, 572, 573, 574, 575, 576, 577, 578, 579, 580, 581, 582, 583, 584, 585, 586, 587, 588, 589, 590, 591, 593, 594, 595, | SHV |

| Peptide SEQ ID No. | Amino acid sequence | Position of the peptide in the SHV protein | Clinical interest |
|---|---|---|---|
| | | 596, 597, 598, 599, 600, 601, 602, 603, 604, 605, 606, 607, 608, 609, 610, 611, 612, 613, 1910, 1912, 1913, 1914, 1915, 1916, 1917, 1918, 1919, 1920; 160-173 for the protein of sequence SEQ ID No. 501; 166-179 for the protein of sequence SEQ ID No. 530; 160-173 for the protein of sequence SEQ ID No. 568; 160-173 for the protein of sequence SEQ ID No. 569 | |
| SEQ ID No. 709 | WETELNEALSGDAR | 161-174 for the protein of SEQ No. 560 | 2b |
| SEQ ID No. 710 | WETELNEVLPGDAR | 161-174 for the protein of SEQ No. 592 | SHV |
| SEQ ID No. 711 | WETER | 161-165 for the protein of SEQ No. 561 | SHV |
| SEQ ID No. 2093 | EIGDNVTR | 150-157 for the proteins of SEQ No. 1915 | SHV |
| SEQ ID No. 2094 | GIVALLGPHNK | 240-250 for the proteins of SEQ No. 1917 | SHV |
| SEQ ID No. 2095 | HLADGMTVGELR | 108-119 for the proteins of SEQ No. 1914 | 2be |
| SEQ ID No. 2096 | IHYSQQDLVDYSPVSEK | 91-107 for the proteins of SEQ No. 1918 | SHV |

In the clinical interest column, the entries 2b, 2br, 2be and 2ber correspond to the functional subgroups of the SHV beta-lactamases which the corresponding peptide makes it possible to detect. Thus, the detection of a 2be peptide will indicate the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The entry SHV indicates a common peptide between at least two of the subgroups 2b, 2br and 2be or 2ber. The corresponding peptide indicates the presence of an SHV beta-lactamase and the presence of a mechanism of resistance at least to penicillins and to first-generation cephalosporins.

The detection of a mechanism of resistance to ESBL (extended-spectrum beta-lactamase) cephalosporins, induced by the SHV protein, is characterised by the detection of at least one resistance-marking 2be peptide, chosen from the sequences SEQ ID No. 616, SEQ ID No. 617, SEQ ID No. 627, SEQ ID No. 629, SEQ ID No. 634, SEQ ID No. 647, SEQ ID No. 648, SEQ ID No. 653, SEQ ID No. 654, SEQ ID No. 656, SEQ ID No. 660, SEQ ID No. 661, SEQ ID No. 662, SEQ ID No. 663, SEQ ID No. 664, SEQ ID No. 665, SEQ ID No. 670, SEQ ID No. 673, SEQ ID No. 674, SEQ ID No. 675, SEQ ID No. 678, SEQ ID No. 682, SEQ ID No. 684, SEQ ID No. 685, SEQ ID No. 686, SEQ ID No. 687, SEQ ID No. 688, SEQ ID No. 697, SEQ ID No. 702, SEQ ID No. 703, SEQ ID No. 704, SEQ ID No. 707, SEQ ID No. 708, SEQ ID No. 709, SEQ ID No. 711, SEQ ID No. 2095.

The detection of a mechanism of resistance to cephalosporins induced by the expression of the FOX protein is characterised by the detection of at least one peptide belonging to the FOX protein and to its different sequence variants SEQ ID No. 712 to SEQ ID No. 718 and SEQ ID No. 1920 to SEQ ID No. 1922.

SEQ ID No. 712:
MQQRRAFALLTLGSLLLAPCTYASGEAPLTAAVDGIIQPMLKAYRIPGMA

VAVLKDGKAHYFNYGVANRESGQRVSEQTLFEIGSVSKTLTATLGAYAAV

KGGFELDDKVSQHAPWLKGSALDGVTMAELATYSAGGLPLQFPDEVDSND

KMRTYYRSWSPVYPAGTHRQYSNPSIGLFGHLAANSLGQPFEQLMSQTLL

PKLGLHHTYIQVPESAMVNYAYGYSKEDKPVRVTPGVLAAEAYGIKTGSA

DLLKFAEANMGYQGDAAVKSAIALTHTGFYSVGDMTQGLGWESYAYPVTE

QTLLAGNAPAVSFQANPVTRFAVPKAMGEQRLYNKTGSTGGFGAYVAFVP

ARGIAIVMLANRNYPIEARVKAAHAILSQLAE

SEQ ID No. 713:
MQQRRAFALLTLGSLLLAPCTYASGEAPLTAAVDGIIQPMLKAYRIPGMA

VAVLKDGKAHYFNYGVANRESGQRVSEQTLFEIGSVSKTLTATLGAYAAV

KGGFELDDKVSQHAPWLKGSALDGVTMAELATYSAGGLPLQFPDEVDSND

KMRTYYRSWSPVYPAGTHRQYSNPSIGLFGHLAANSLGQPFEQLMSQTLL

PKLGLHHTYIQVPESAMVNYAYGYSKEDKPVRVTPGVLAAEAYGIKTGSA

DLLKFAEANMGYQGDAAVKSAIALTHTGFYSVGDMTQGLGWESYAYPVTE

QTLLAGNAPAVSFQANPVTRFAVPKAMGEQRLYNKTGSTGGFGAYVAFVP

ARGIAIVMLANRNYPIEARVKAAHAILSQLAE

SEQ ID No. 14:
MQQRRAFALLTLGSLLLAPCTYARGEAPLTAAVDGIIQPMLKEYRIPGMA

VAVLKDGKAHYFNYGVANRESGQRVSEQTLFEIGSVSKTLTATLGAYAAV

KGGFELDDKVSQHAPWLKGSAFDGVTMAELATYSAGGLPLQFPDEVDSND

KMRTYYRHWSPVYPAGTHRQYSNPSIGLFGHLAANSLGQPFEQLMSQTLL

PKLGLHHTYIQVPESAIANYAYGYSKEDKPVRVTPGVLAAEAYGIKTGSA

-continued
DLLKFTEANMGYQGDAALKTRIALTHTGFYSVGDMTQGLGWESYAYPLTE

QALLAGNSPAVSFQANPVTRFAVPKAMGEQRLYNKTGSTGGFGAYVAFVP

ARGIAIVMLANRNYPIEARVKAAHAILSQLAE

SEQ ID No. 715:
MQQRRALALLTLGSLLLAPCTYASGEAPLTAAVDGIIQPMLKEYRIPGMA

VAVLKDGKAHYFNYGVANRESGQRVSEQTLFEIGSVSKTLTATLGAYAAV

KGGFELDDKVSHHAPWLKGSAFDGVTMAELATYSAGGLPLQFPDEVDSND

KMQTYYRSWSPVYPAGTHRQYSNPSIGLFGHLAANSLGQPFEKLMSQTLL

PKLGLHHTYIQVPESAMANYAYGYSKEDKPIRVTPGVLAAEAYGIKTGSA

DLLKFVEANMGYQGDAALKSAIALTHTGFYSVGDMTQGLGWESYAYPVTE

QALLAGNSPAVSFQANPVTRFAVPKAMGEQRLYNKTGSTGGFGAYVAFVP

ARGIAIVMLANRNYPIEARVKAAHAILSQLAE

SEQ ID No. 716:
MQQRRAFALLTLGSLLLAPCTYASGEAPLTATVDGIIQPMLKEYRIPGIA

VAVLKDGKAHYFNYGVANRESGQRVSEQTLFEIGSVSKTLTATLGAYAAV

KGGFVLDDKVSQHAPWLKGSALDGVTMAELATYSAGGLPLQFPDKVDSND

KMQTYYRSWSPVYPAGTHRQYSNPSIGLFGHLAANSLGQPFEQLMSQTLL

PKLGLHHTYIQVPESAMANYAYGYSKEDKPIRVTPGVLAAEAYGIKTGSA

DLLKFAEANMGYQGDALVKSAIALTHTGFYSVGEMTQGLGWESYDYPVTE

QVLLAGNSPAVSFQANPVTRFAVPKAMGEQRLYNKTGSTGGFGAYVAFVP

ARGIAIVMLANRNYPIEARVKAAHAILSQLAE

SEQ ID No. 717:
MQQRRALALLMLGSLLLAPCTYASGEAPLTATVDGIIQPMLKAYRIPGMA

VAVLKDGKAHYFNYGVANRESGQRVSEQTLFEIGSVSKTLTATLGAYAAV

KGGFELDDKVSQHAPWLKGSAFDGVTMAELATYSAGGLPLQFPDEVDSND

KMQTYYRSWSPVYPAGTHRQYSNPSIGLFGHLAANSLGQPFEQLMSQTLL

PKLGLHHTYIQVPESAMANYAYGYSKEDKPIRATPGVLAAEAYGIKTGSA

DLLKFVEANMGYQGDAALKSAIALTHTGFHSVGEMTQGLGWESYDYPVTE

QVLLAGNSPAVSFQANPVTRFAVPKAMGEQRLYNKTGSTGGFGAYVAFVP

ARGIAIVMLANRNYPIEARVKAAHAILSQLAE

SEQ ID No. 718:
MQQRRAFALLTLGSLLLAPCTYARGEAPLTAAVDGIIQPMLKEYRIPGMA

VAVLKDGKAHYFNYGVANRESGQRVSEQTLFEIGSVSKTLTATLGAYAAV

KGGFELDDKVSQHAPWLKGSAFDGVTMAELATYSAGGLPLQFPDEVDSND

KMRTYYRHWSPVYPAGTHRQYSNPSIGLFGHLAANSLGQPFEQLMSQTLL

PKLGLHHTYIQVPESAIANYAYGYSKEDKPVRATPGVLAAEAYGIKTGSA

DLLKFTEANMGYQGDAALKSAIALTHTGFYSVGDMTQGLGWESYAYPLTE

QALLAGNSPAVSFQANPVTRFAVPKAMGEQRLYNKTGSTGGFGAYVAFVP

ARGIAIVMLANRNYPIEARVKAAHAILSQLAE

SEQ ID No. 1920:
MQQRRAFALLTLGSLLLAPCTYASGEAPLTATVDGIIQPMLKEYRIPGIA

VAVLKDGKAHYFNYGVANRESGQRVSEQTLFEIGSVSKTLTATLGAYAAV

KGGFVLDDKVSQHAPWLKGSALDGVTMAELATYSAGGLPLQFPDKVDSND

KMQTYYRSWSPVYPAGTHRQYSNPSIGLFGHLAANSLGQPFEQLMSQTLL

PKLGLHHTYIQVPESAMANYAYGYSKEDKPIRVTPGVLAAEAYGIKTGSA

DLLKFAEANMGYQGDALVKSAIALTHTGFYSVGEMTQGLGWESYDYPVTE

QVLLAGNSPAVSLQANPVTRFAVPKAMGEQRLYNKTGSTGGFGAYVAFVP

ARGIAIVMLANRNYPIEARVKAAHAILSQLAE

SEQ ID No. 1921:
MQQRRAFALLTLGSLLLAPCTYASGEAPLTVTVDGIIQPMLKAYRIPGMA

VAVLKDGKAHYFNYGVANRESGQRVSEQTLFEIGSVSKTLTATLGAYAAV

KGGFELDDKVSQHAPWLKGSAFDGVTMAELATYSAGGLPLQFPEEVDSND

KMRTYYRSWSPVYPAGTHRQYANTSIGLFGYLAANSLGQSFEQLMSQTLL

PKLGLHHTYIQVPESAMANYAYGYSKEEKPIRVTPGMLAAEAYGIKTGSA

DLLKFAEANMGYQGDAAVKSAIALTHTGFYSVGDMTQGLGWESYDYPVTE

QVLLADNSPAVSFQANPVTRFAVPKAMGEQRLYNKTGSTGGFGAYVAFVP

ARGIAIVMLANRNYPIEARVKAAHAILSQLAE

SEQ ID No. 1922:
MQQRRAFALLTLGSLLLAPCTYASGEAPLTATVDGIIQPMLKEYRIPGIA

VAVLKDGKAHYFNYGVANRESGQRVSEQTLFEIGSVSKTLTATLGAYAAV

KGGFVLDDKVSQHAPWLKGSALDGVTMAELATYSAGGLPLQFPDKVDSND

KMQTYYRSWSPVYPAGTHRQYSNPSIGLFGHLAANSLGQPFEQLMSQTLL

PKLGLHHTYIQVPESAMANYAYGYSKEDKPIRVTPGVLAAEAYGIKTGSA

DLLKFAEANMGYQGDALVKSAIALTHTGFYSVGEMTQGLGWESYDYPVTE

QVLLAGNSPAVSFQANPVTRFAVPKAMGEQRLYNKTGSTGGFGAYVAFVP

ARGIAIVMLANRNYPIEARVKAAHAILSQLAE said peptides being chosen, preferably, from the peptides of sequence SEQ ID No. 719 to SEQ ID No. 733 and SEQ ID No. 2097 to SEQ ID No. 2113 as defined hereafter:

| Peptide SEQ ID No. | Amino acid sequence | Position of the peptide in the FOX protein |
|---|---|---|
| SEQ ID No. 719 | AHYFNYGVANR | 59-69 for the proteins of SEQ No. 712, 713, 714, 715, 716, 717, 718, 1920, 1921, 1922 |
| SEQ ID No. 720 | AMGEQR | 326-331 for the proteins of SEQ No. 712, 713, 714, 715, 716, 717, 718, 1920, 1921, 1922 |
| SEQ ID No. 721 | ESGQR | 70-74 for the proteins of SEQ No. 712, 713, 714, 715, 716, 717, 718, 1920, 1921, 1922 |

-continued

| Peptide SEQ ID No. | Amino acid sequence | Position of the peptide in the FOX protein |
|---|---|---|
| SEQ ID No. 722 | FAVPK | 321-325 for the proteins of SEQ No. 712, 713, 714, 715, 716, 717, 718, 1920, 1921, 1922 |
| SEQ ID No. 723 | GGFELDDK | 102-109 for the proteins of SEQ No. 712, 713, 714, 715, 717, 718, 1921 |
| SEQ ID No. 724 | GIAIVMLANR | 353-362 for the proteins of SEQ No. 712, 713, 714, 715, 716, 717, 718, 1920, 1921, 1922 |
| SEQ ID No. 725 | IPGMAVAVLK | 46-55 for the proteins of SEQ No. 712, 713, 714, 715, 717, 718, 1921 |
| SEQ ID No. 726 | NYPIEAR | 363-369 for the proteins of SEQ No. 712, 713, 714, 715, 716, 717, 718, 1920, 1921, 1922 |
| SEQ ID No. 727 | SWSPVYPAGTHR | 158-169 for the proteins of SEQ No. 712, 713, 715, 716, 717, 1920, 1921, 1922 |
| SEQ ID No. 728 | TGSADLLK | 247-254 for the proteins of SEQ No. 712, 713, 714, 715, 716, 717, 718, 1920, 1921, 1922 |
| SEQ ID No. 729 | TGSTGGFGAYVAFVPAR | 336-352 for the proteins of SEQ No. 712, 713, 714, 715, 716, 717, 718, 1920, 1921, 1922 |
| SEQ ID No. 730 | TLTATLGAYAAVK | 89-101 for the proteins of SEQ No. 712, 713, 714, 715, 716, 717, 718, 1920, 1921, 1922 |
| SEQ ID No. 731 | VSEQTLFEIGSVSK | 75-88 for the proteins of SEQ No. 712, 713, 714, 715, 716, 717, 718, 1920, 1921, 1922 |
| SEQ ID No. 732 | VSQHAPWLK | 110-118 for the proteins of SEQ No. 712, 713, 714, 716, 717, 718, 1920, 1921, 1922 |
| SEQ ID No. 733 | VTPGVLAAEAYGIK | 233-246 for the proteins of SEQ No. 712, 713, 714, 715, 716, 1920, 1922 |
| SEQ ID No. 2097 | AFALLTLGSLLLAPCTYAR | 6-24 for the proteins of SEQ No. 714, 718 |
| SEQ ID No. 2098 | ATPGVLAAEAYGIK | 233-246 for the proteins of SEQ No. 717, 718 |
| SEQ ID No. 2099 | EDKPVR | 227-232 for the proteins of SEQ No. 712, 713, 714, 718 |
| SEQ ID No. 2100 | EEKPIR | 227-232 for the proteins of SEQ No. 1921 |
| SEQ ID No. 2101 | FAEANMGYQGDAAVK | 255-269 for the proteins of SEQ No. 712, 713, 1921 |
| SEQ ID No. 2102 | FAEANMGYQGDALVK | 255-269 for the proteins of SEQ No. 716, 1920, 1922 |
| SEQ ID No. 2103 | FTEANMGYQGDAALK | 255-269 for the proteins of SEQ No. 714, 718 |
| SEQ ID No. 2104 | FVEANMGYQGDAALK | 255-269 for the proteins of SEQ No. 715, 717 |
| SEQ ID No. 2105 | GEAPLTAAVDGIIQPMLK | 25-42 for the proteins of SEQ No. 712, 713, 714, 715, 718 |
| SEQ ID No. 2106 | GGFVLDDK | 102-109 for the proteins of SEQ No. 716, 1920, 1922 |
| SEQ ID No. 2107 | HWSPVYPAGTHR | 158-169 for the proteins of SEQ No. 714, 718 |
| SEQ ID No. 2108 | IPGIAVAVLK | 46-55 for the proteins of SEQ No. 716, 1920, 1922 |
| SEQ ID No. 2109 | LMSQTLLPK | 194-202 for the proteins of SEQ No. 712, 713, 714, 715, 716, 717, 718, 1920, 1921, 1922 |

-continued

| Peptide SEQ ID No. | Amino acid sequence | Position of the peptide in the FOX protein |
|---|---|---|
| SEQ ID No. 2110 | MQTYYR | 152-157 for the proteins of SEQ No. 715, 716, 717, 1920, 1922 |
| SEQ ID No. 2111 | VDSNDK | 146-151 for the proteins of SEQ No. 712, 713, 714, 715, 716, 717, 718, 1920, 1921, 1922 |
| SEQ ID No. 2112 | VSHHAPWLK | 110-118 for the protein of SEQ No. 715 |
| SEQ ID No. 2113 | VTPGMLAAEAYGIK | 233-246 for the proteins of SEQ No. 1921 |

The detection of a mechanism of resistance to cephalosporins induced by the expression of the ACC protein is characterised by the detection of at least one peptide belonging to the ACC protein and to its different sequence variants SEQ ID No. 736 to SEQ ID No. 739.

SEQ ID No. 736:
MRKKMQNTLKLLSVITCLAATAQGAMAANIDESKIKDTVDGLIQPLMQKN

NIPGMSVAVTIRGRNYIYNYGLAAKQPQQPVTENTLFEVGSLSKTFAAIL

ASYAQASGKLSLEQSVSHYVPELRGSSFDHVSVLNVGTHTSGLQLFMPED

IKNTTQLMTYLKAWKPADAAGTHRVYSNIGTGLLGMIAAKSLGVSYEDAI

EQTILPLLGMNQTYLKVPADQMENYAWGYNKKDEPVHVNMEILGNEAYGI

KTTSSDLLRYVQANMGQLKLDGNAKIQHALTATHTGYFKSGEITQDLMWE

QLPYPVSLPNLLTGNDMAMTKSVATPIVPPLPPQENVWINKTGSTNGFGA

YIAFVPAKKMGIVMLANKNYSIDQRVTVAYKILSSLEVNK

SEQ ID No. 737:
MRKKMQNTLKMLSVITCLALTAQGAMASEMDQAKIKDTVDSLIQPLMQKN

NIPGMSVAVTLNGKNYIYNYGLASKQPQQPVTDNTLFEVGSLSKTFAATL

ASYAQVSGKLSLDKSISHYVPELRGSSFDHISVLNAGTHTTGLALFMPEE

VKNTDQLMAYLKAWKPADPAGTHRVYSNIGTGLLGMIAAQSMGMTYEDAI

EKTLLPKLGMTHTYLNVPADQAENYAWGYNKKNEPIHVNMEVLGNEAYGI

RTNASDLIRYVQANMGQLKLDGNSTLQKALTDTHIGYFKSGKITQDLMWE

QLPYPVSLPDLLTGNDMAMTKSVATPIVPPLPPQENVWINKTGSTNGFGA

YIAFVPAKKMGIVMLANKNYSIDQRVT

SEQ ID No. 738:
MQNTLKLLSVITCLAATVQGALAANIDESKIKDTVDDLIQPLMQKNNIPG

MSVAVTVNGKNYIYNYGLAAKQPQQPVTENTLFEVGSLSKTFAATLASYA

QVSGKLSLDQSVSHYVPELRGSSFDHVSVLNVGTHTSGLQLFMPEDIKNT

TQLMAYLKAWKPADAAGTHRVYSNIGTGLLGMIAAKSLGVSYEDAIEKTL

LPQLGMHHSYLKVPADQMENYAWGYNKKDEPVHGNMEILGNEAYGIKTTS

SDLLRYVQANMGQLKLDANAKMQQALTATHTGYFKSGEITQDLMWEQLPY

PVSLPNLLTGNDMAMTKSVATPIVPPLPPQENVWINKTGSTNGFGAYIAF

VPAKKMGIVMLANKNYSIDQRVTVAYKILSSLEGNK

SEQ ID No. 739:
MQNTLKLLSVITCLAATVQGALAANIDESKIKDTVDDLIQPLMQKNNIPG

MSVAVTVNGKNYIYNYGLAAKQPQQPVTENTLFEVGSLSKTFAATLASYA

QVSGKLSLDQSVSHYVPELRGSSFDHVSVLNVGTHTSGLQLFMPEDIKNT

TQLMAYLKAWKPADAAGTHRVYSNIGTGLLGMIAAKSLGVSYEDAIEKTL

LPQLGMHHSYLKVPADQMENYAWGYNKKDEPVHVNMEILGNEAYGIKTTS

SDLLRYVQANMGQLKLDANAKMQQALTATHTGYFKSGEITQDLMWEQLPY

PVSLPNLLTGNDMAMTKSVATPIVPPLPPQENVWINKTGSTNGFGAYIAF

VPAKKMGIVMLANKNYSIDQRVTVAYKILSSLEGNK said peptides being chosen, preferably, from the peptides of sequence SEQ ID No. 740 to SEQ ID No. 787 as defined hereafter:

| Peptide SEQ ID No. | Amino acid sequence | Position of the peptide in the ACC protein(s) |
|---|---|---|
| SEQ ID No. 740 | ALTDTHIGYFK | 279-289 for the protein of SEQ No. 737 |
| SEQ ID No. 741 | AWKPADAAGTHR | 159-170 for the proteins of SEQ No. 738, 739; 163-174 for the protein of sequence SEQ ID No. 736 |
| SEQ ID No. 742 | AWKPADPAGTHR | 163-174 for the protein of SEQ No. 737 |
| SEQ ID No. 743 | DEPVHGNMEILGNEAYGIK | 229-247 for the protein of SEQ No. 738 |

-continued

| Peptide SEQ ID No. | Amino acid sequence | Position of the peptide in the ACC protein(s) |
|---|---|---|
| SEQ ID No. 744 | DEPVHVNMEILGNEAYGIK | 229-247 for the protein of SEQ No. 739; 233-251 for the protein of sequence SEQ ID No. 736 |
| SEQ ID No. 745 | DTVDDLIQPLMQK | 33-45 for the proteins of SEQ No. 738, 739 |
| SEQ ID No. 746 | DTVDGLIQPLMQK | 37-49 for the protein of SEQ No. 736 |
| SEQ ID No. 747 | DTVDSLIQPLMQK | 37-49 for the protein of SEQ No. 737 |
| SEQ ID No. 748 | IQHALTATHTGYFK | 276-289 for the protein of SEQ No. 736 |
| SEQ ID No. 749 | LDANAK | 266-271 for the proteins of SEQ No. 738, 739 |
| SEQ ID No. 750 | LDGNAK | 270-275 for the protein of SEQ No. 736 |
| SEQ ID No. 751 | LDGNSTLQK | 270-278 for the protein of SEQ No. 737 |
| SEQ ID No. 752 | LGMTHTYLNVPADQAENYAWGYNK | 208-231 for the protein of SEQ No. 737 |
| SEQ ID No. 753 | LLSVITCLAATAQGAMAANIDESK | 11-34 for the protein of SEQ No. 736 |
| SEQ ID No. 754 | LLSVITCLAATVQGALAANIDESK | 7-30 for the proteins of SEQ No. 738, 739 |
| SEQ ID No. 755 | LSLDK | 110-114 for the protein of SEQ No. 737 |
| SEQ ID No. 756 | LSLDQSVSHYVPELR | 106-120 for the proteins of SEQ No. 738, 739 |
| SEQ ID No. 757 | LSLEQSVSHYVPELR | 110-124 for the protein of SEQ No. 736 |
| SEQ ID No. 758 | MGIVMLANK | 356-364 for the proteins of SEQ No. 738, 739; 360-368 for the proteins of sequence SEQ ID No. 736, 737 |
| SEQ ID No. 759 | MLSVITCLALTAQGAMASEMDQAK | 11-34 for the protein of SEQ No. 737 |
| SEQ ID No. 760 | MQNTLK | 1-6 for the proteins of SEQ No. 738, 739; 5-10 10 for the proteins of sequence SEQ ID No. 736, 737 |
| SEQ ID No. 761 | MQQALTATHTGYFK | 272-285 for the proteins of SEQ No. 738, 739 |
| SEQ ID No. 762 | NEPIHVNMEVLGNEAYGIR | 233-251 for the protein of SEQ No. 737 |
| SEQ ID No. 763 | NNIPGMSVAVTIR | 50-62 for the protein of SEQ No. 736 |
| SEQ ID No. 764 | NNIPGMSVAVTLNGK | 50-64 for the protein of SEQ No. 737 |
| SEQ ID No. 765 | NNIPGMSVAVTVNGK | 46-60 for the proteins of SEQ No. 738, 739 |
| SEQ ID No. 766 | NTDQLMAYLK | 153-162 for the protein of SEQ No. 737 |
| SEQ ID No. 767 | NTTQLMAYLK | 149-158 for the proteins of SEQ No. 738, 739 |

-continued

| Peptide SEQ ID No. | Amino acid sequence | Position of the peptide in the ACC protein(s) |
|---|---|---|
| SEQ ID No. 768 | NTTQLMTYLK | 153-162 for the protein of SEQ No. 736 |
| SEQ ID No. 769 | NYIYNYGLAAK | 61-71 for the proteins of SEQ No. 738, 739; 65-75 for the protein of sequence SEQ ID No. 736 |
| SEQ ID No. 770 | NYIYNYGLASK | 65-75 for the protein of SEQ No. 737 |
| SEQ ID No. 771 | NYSIDQR | 365-371 for the proteins of SEQ No. 738, 739; 369-375 for the protein of sequence SEQ ID No. 736, 737 |
| SEQ ID No. 772 | QPQQPVTDNTLFEVGSLSK | 76-94 for the protein of SEQ No. 737 |
| SEQ ID No. 773 | QPQQPVTENTLFEVGSLSK | 72-90 for the proteins of SEQ No. 738, 739; 76-94 for the protein of sequence SEQ ID No. 736 |
| SEQ ID No. 774 | SISHYVPELR | 115-124 for the protein of SEQ No. 737 |
| SEQ ID No. 775 | SLGVSYEDAIEK | 187-198 for the proteins of SEQ No. 738, 739 |
| SEQ ID No. 776 | SVATPIVPPLPPQENVWINK | 318-337 for the proteins of SEQ No. 738, 739; 322-341 for the protein of sequence SEQ ID No. 736, 737 |
| SEQ ID No. 777 | TFAAILASYAQASGK | 95-109 for the protein of SEQ No. 736 |
| SEQ ID No. 778 | TFAATLASYAQVSGK | 91-105 for the proteins of SEQ No. 738, 739; 95-109 for the protein of sequence SEQ ID No. 737 |
| SEQ ID No. 779 | TGSTNGFGAYIAFVPAK | 338-354 for the proteins of SEQ No. 738, 739; 342-358 for the protein of sequence SEQ ID No. 736, 737 |
| SEQ ID No. 780 | TLLPK | 203-207 for the protein of SEQ No. 737 |
| SEQ ID No. 781 | TLLPQLGMHHSYLK | 199-212 for the proteins of SEQ No. 738, 739 |
| SEQ ID No. 782 | TNASDLIR | 252-259 for the protein of SEQ No. 737 |
| SEQ ID No. 783 | TTSSDLLR | 248-255 for the proteins of SEQ No. 738, 739; 252-259 for the protein of sequence SEQ ID No. 736 |
| SEQ ID No. 784 | VPADQMENYAWGYNK | 213-227 for the proteins of SEQ No. 738, 739; 217-231 for the protein of sequence SEQ ID No. 736 |
| SEQ ID No. 785 | VTVAYK | 372-377 for the proteins of SEQ No. 738, 739; 376-381 for the protein of sequence SEQ ID No. 736 |
| SEQ ID No. 786 | VYSNIGTGLLGMIAAK | 171-186 for the proteins of SEQ No. 738, 739; 175-190 for the protein of sequence SEQ ID No. 736 |
| SEQ ID No. 787 | YVQANMGQLK | 256-265 for the proteins of SEQ No. 738, 739; 260-269 for the protein of sequence SEQ ID No. 736, 737 |

The detection of a mechanism of resistance to cephalosporins induced by the expression of the ACT protein is characterised by the detection of at least one peptide belonging to the ACT protein and to its different sequence variants SEQ ID No. 788 to SEQ ID No. 794.

SEQ ID No. 788:
MMMTKSLCCALLLSTSCSVLATPMSEKQLAEVVERTVTPLMKAQAIPGMA

VAVIYEGQPHYFTFGKADVAANKPVTPQTLFELGSISKTFTGVLGGDAIA

RGEISLGDPVTKYWPELTGKQWQGIRMLDLATYTAGGLPLQVPDEVKDNA

SLLRFYQNWQPQWKPGTTRLYANASIGLFGALAVKPSGMSYEQAITTRVF

KPLKLDHTWINVPKAEEAHYAWGYRDGKAVHVSPGMLDAEAYGVKTNVQD

MASWVMVNMKPDSLQDNSLRKGLTLAQSRYWRVGAMYQGLGWEMLNWPVD

AKTVVEGSDNKVALAPLPAREVNPPAPPVNASWVHKTGSTGGFGSYVAFI

PEKQLGIVMLANKSYPNPARVEAAYRILSAL

SEQ ID No. 789:
MMMTKSLCCALLLSTSCSVLATPMSEKQLAEVVERTVTPLMKAQAIPGMA

VAVIYEGQPHYFTFGKADVAANKPVTPQTLFELGSISKTFTGVLGGDAIA

RGEISLGDPVTKYWPELTGKQWQGIRMLDLATYTAGGLPLQVPDEVTDNA

SLLRFYQNWQPQWKPGTTRLYANASIGLFGALAVKPSGMSYEQAITTRVF

KPLKLDHTWINVPKAEEAHYAWGYRDGKAIHVSPGMLDAEAYGVKTNVQD

MASWVMVNMKPDSLQDNSLRKGLTLAQSRYWRVGAMYQGLGWEMLNWPVD

AKTVVEGSDNKVALAPLPAREVNPPAPPVNASWVHKTGSTGGFGSYVAFI

PEKQLGIVMLANKSYPNPARVEAAYRILSAL

SEQ ID No. 790:
MMTKSLCCALLLSTSCSVLAAPMSEKQLAEVVERTVTPLMKAQAIPGMAV

AVIYQGQPHYFTFGKADVAANKPVTPQTLFELGSISKTFTGVLGGDAIAR

GEISLGDPVTKYWPELTGKQWQGIRMLDLATYTAGGLPLQVPDEVADNAS

LLRFYQNWQPQWKPGTTRLYANTSIGLFGALAVKPSGMSYEQAITTRVFK

PLKLDHTWINVPKAEEAHYAWGYRDGKAVHVSPGMLDAEAYGVKTNVQDM

ASWVMVNMKPDSLQDNSLRQGIALAQSRYWRVGAMYQGLGWEMLNWPVDA

KTVVEGSDNKVALAPLPAREVNPPAPPVNASWVHKTGSTGGFGSYVAFIP

EKQLGIVMLANKSYPNPARVEAAYRILSAL

SEQ ID No. 791:
MMTKSLCCALLLSTSCSVLAAPMSEKQLAEVVERTVTPLMKAQAIPGMAV

AVIYQGQPHYFTFGKADVAANKPVTPQTLFELGSISKTFTGVLGGDAIAR

GEISLGDPVTKYWPELTGKQWQGIRMLDLATYTAGGLPLQVPDEVTDNAS

LLRFYQNWQPQWKPGTTRLYANASIGLFGALAVKPSGMSYEQAITTRVFK

PLKLDHTWINVPKAEEAHYAWGYRDGKAVHVSPGMLDAEAYGVKTNVKDM

ANWVMVNMKPDSLQDSSLKEGITLAQSRYWRVGAMYQGLGWEMLNWPVDA

KTVVEGSDNKVALAPLPAREVNPPAPPVNASWVHKTGSTGGFGSYVAFIP

EKQLGIVMLANKSYPNPARVEAAYRILDALQ

SEQ ID No. 792:
MMRKSLCCALLLGISCSALATPVSEKQLAEVVANTVTPLMKAQSVPGMAV

AVIYQGKPHYYTFGKADIAANKPVTPQTLFELGSISKTFTGVLGGDAIAR

GEISLDDPVTRYWPQLTGKQWQGIRMLDLATYTAGGLPLQVPDEVTDNAS

LLRFYQNWQPQWKPGTTRLYANASIGLFGALAVKPSGMPYEQAMTTRVLK

PLKLDHTWINVPKAEEAHYAWGYRDGKAVRVSPGMLDAQAYGVKTNVQDM

ANWVMANMAPENVADASLKQGIALAQSRYWRIGSMYQGLGWEMLNWPVEA

NTVVEGSDSKVALAPLPVAEVNPPAPPVKASWVHKTGSTGGFGSYVAFIP

EKQIGIVMLANTSYPNPARVEAAYHILEALQ

SEQ ID No. 793:
MMKKSLCCALLLGISCSALAAPVSEKQLAEVVANTVTPLMKAQSIPGMAV

AVIYQGKPHYYTFGKADIAASKPVTPQTLFELGSISKTFTGVLGGDAIAR

GEISLDDPVTRYWPQLTGKQWQGIRMLDLATYTAGGLPLQVPDEVTDNAA

LLRFYQNWQPQWKPGTTRLYANASIGLFGALAVKPSGMPFEQAMTTRVLK

PLKLDHTWINVPKAEEAHYAWGYRDGKAVRVSPGMLDAQAYGMKTNVQDM

ANWVMANMAPENVADASLKQGISLAQSRYWRIGSMYQGLGWEMLNWPVEA

NTVIEGSDSKVALAPLPVAEVNPPAPPVKASWVHKTGSTGGFGSYVAFIP

EKQIGIVMLANKSYPNPARVEAAYPILDALQ

SEQ ID No. 794:
MMMTKSLCCALLLSTSCSVLATPMSEKQLAEVVERTVTPLMKAQAIPGMA

VAVIYEGQPHYFTFGKADVAANKPVTPQTLFELGSISKTFTGVLGGDAIA

RGEISLGDPVTKYWPELTGKQWQGIRMLDLATYTAGGLPLQVPDEVTDNA

SLLRFYQNWQPQWKPGTTRLYANASIGLFGALAVKPSGMSYEQAITTRVF

KPLKLDHTWINVPKAEEAHYAWGYRDGKAVHVSPGMLDAEAYGVKTNVQD

MASWVMVNMKPDSLQDNSLRKGLTLAQSRYWRVGAMYQGLGWEMLNWPVD

AKTVVEGSDNKVALAPLPAREVNPPAPPVNASWVHKTGSTGGFGSYVAFI

PEKQLGIVMLANKSYPNPARVEAAYRILSAL said peptides being chosen, preferably, from the peptides of sequence SEQ ID No. 795 to SEQ ID No. 841 as defined hereafter:

| Peptide SEQ ID No. | Amino acid sequence | Position of the peptide in the ACT protein(s) |
|---|---|---|
| SEQ ID No. 795 | ADIAANK | 66-72 for the protein of SEQ No. 792 |
| SEQ ID No. 796 | ADIAASK | 66-72 for the protein of SEQ No. 793 |
| SEQ ID No. 797 | ADVAANK | 67-73 for the proteins of SEQ No. 788, 789, 794; 66-72 for the protein of sequence SEQ ID No. 790, 791 |

-continued

| Peptide SEQ ID No. | Amino acid sequence | Position of the peptide in the ACT protein(s) |
|---|---|---|
| SEQ ID No. 798 | AEEAHYAWGYR | 215-225 for the proteins of SEQ No. 788, 789, 794; 214-224 for the proteins of sequence SEQ ID No. 790, 791, 792, 793 |
| SEQ ID No. 799 | AIHVSPGMLDAEAYGVK | 229-245 for the protein of SEQ No. 789 |
| SEQ ID No. 800 | AQSIPGMAVAVIYQGK | 42-57 for the protein of SEQ No. 793 |
| SEQ ID No. 801 | AQSVPGMAVAVIYQGK | 42-57 for the protein of SEQ No. 792 |
| SEQ ID No. 802 | AVHVSPGMLDAEAYGVK | 229-245 for the proteins of SEQ No. 788, 794; 228-244 for the proteins of sequence SEQ ID No. 790, 791 |
| SEQ ID No. 803 | DMANWVMVNMK | 249-259 for the protein of SEQ No. 791 |
| SEQ ID No. 804 | DMANWVMVNMKPDSLQDSSLK | 249-269 for the protein of SEQ No. 791 |
| SEQ ID No. 805 | DNASLLR | 148-154 for the proteins of SEQ No. 788, 789, 794; 147-153 for the proteins of sequence SEQ ID No. 790, 791, 792 |
| SEQ ID No. 806 | EGITLAQSR | 270-278 for the protein of SEQ No. 791 |
| SEQ ID No. 807 | EVNPPAPPVNASWVHK | 321-336 for the proteins of SEQ No. 788, 789, 794; 320-335 for the proteins of sequence SEQ ID No. 790, 791 |
| SEQ ID No. 808 | FYQNWQPQWK | 155-164 for the proteins of SEQ No. 788, 789, 794; 154-163 for the proteins of sequence SEQ ID No. 790, 791, 792, 793 |
| SEQ ID No. 809 | FYQNWQPQWKPGTTR | 155-169 for the proteins of SEQ No. 788, 789, 794; 154-168 for the proteins of sequence SEQ ID No. 790, 791, 792, 793 |
| SEQ ID No. 810 | GEISLDDPVTR | 101-111 for the proteins of SEQ No. 792, 793 |
| SEQ ID No. 811 | GEISLGDPVTK | 102-112 for the proteins of SEQ No. 788, 789, 794; 101-111 for the proteins of sequence SEQ ID No. 790, 791 |
| SEQ ID No. 812 | GLTLAQSR | 272-279 for the proteins of SEQ No. 788, 789, 794 |
| SEQ ID No. 813 | LDHTWINVPK | 205-214 for the proteins of SEQ No. 788, 789, 794; 204-213 the proteins of sequence SEQ ID No. 791, 792, 793 |
| SEQ ID No. 814 | LYANASIGLFGALAVK | 170-185 for the proteins of SEQ No. 788, 789, 794; 169-184 for the proteins of sequence SEQ ID No. 791, 792, 793 |
| SEQ ID No. 815 | LYANTSIGLFGALAVK | 169-184 for the protein of SEQ No. 790 |
| SEQ ID No. 816 | MLDLATYTAGGLPLQVPDEVK | 127-147 for the protein of SEQ No. 788 |
| SEQ ID No. 817 | QGIALAQSR | 270-278 for the proteins of SEQ No. 790, 792 |
| SEQ ID No. 818 | QGISLAQSR | 270-278 for the protein of SEQ No. 793 |
| SEQ ID No. 819 | QIGIVMLANK | 353-362 for the protein of SEQ No. 793 |

-continued

| Peptide SEQ ID No. | Amino acid sequence | Position of the peptide in the ACT protein(s) |
|---|---|---|
| SEQ ID No. 820 | QIGIVMLANTSYPNPAR | 353-369 for the protein of SEQ No. 792 |
| SEQ ID No. 821 | QLAEVVANTVTPLMK | 27-41 for the proteins of SEQ No. 792, 793 |
| SEQ ID No. 822 | QLAEVVER | 28-35 for the proteins of SEQ No. 788, 789, 794; 27-34 for the proteins of sequence SEQ ID No. 790, 791 |
| SEQ ID No. 823 | QLGIVMLANK | 354-363 for the proteins of SEQ No. 788, 789, 794; 353-362 for the proteins of sequence SEQ ID No. 790, 791 |
| SEQ ID No. 824 | SYPNPAR | 364-370 for the proteins of SEQ No. 788, 789, 794; 363-369 for the proteins of sequence SEQ ID No. 790, 791, 792, 793 |
| SEQ ID No. 825 | TFTGVLGGDAIAR | 89-101 for the proteins of SEQ No. 788, 789, 794; 88-100 for the proteins of sequence SEQ ID No. 790, 791, 792, 793 |
| SEQ ID No. 826 | TGSTGGFGSYVAFIPEK | 337-353 for the proteins of SEQ No. 788, 789, 794; 336-352 for the proteins of sequence SEQ ID No. 790, 791, 792, 793 |
| SEQ ID No. 827 | TNVQDMASWVMVNMK | 246-260 for the proteins of SEQ No. 788, 789, 794; 245-259 for the protein of sequence SEQ ID No. 790 |
| SEQ ID No. 828 | TVTPLMK | 36-42 for the proteins of SEQ No. 788, 789, 794; 35-41 for the proteins of sequence SEQ ID No. 790, 791, 792, 793 |
| SEQ ID No. 829 | TVVEGSDNK | 303-311 for the proteins of SEQ No. 788, 789, 794; 302-310 for the proteins of sequence SEQ ID No. 790, 791 |
| SEQ ID No. 830 | VALAPLPAR | 312-320 for the proteins of SEQ No. 788, 789, 794; 311-319 for the proteins of sequence SEQ ID No. 790, 791 |
| SEQ ID No. 831 | VALAPLPVAEVNPPAPPVK | 311-329 for the proteins of SEQ No. 792, 793 |
| SEQ ID No. 832 | VEAAYR | 371-376 for the proteins of SEQ No. 788, 789, 794; 370-375 for the proteins of sequence SEQ ID No. 790, 791 |
| SEQ ID No. 833 | VFKPLK | 199-204 for the proteins of SEQ No. 788, 789, 794; 198-203 for the proteins of sequence SEQ ID No. 790, 791 |
| SEQ ID No. 834 | VGAMYQGLGWEMLNWPVDAK | 283-302 for the proteins of SEQ No. 788, 789, 794; 282-301 for the proteins of sequence SEQ ID No. 790, 791 |
| SEQ ID No. 835 | VLKPLK | 198-203 for the proteins of SEQ No. 792, 793 |
| SEQ ID No. 836 | VSPGMLDAQAYGMK | 231-244 for the protein of SEQ No. 793 |
| SEQ ID No. 837 | VSPGMLDAQAYGVK | 231-244 for the protein of SEQ No. 792 |
| SEQ ID No. 838 | YWPQLTGK | 112-119 for the proteins of SEQ No. 792, 793 |
| SEQ ID No. 839 | ASWVHK | 331-336 for the proteins of SEQ No. 788, 789, 794; 330-335 for the proteins of sequence SEQ ID No. 790, 791, 792, 793 |

| Peptide SEQ ID No. | Amino acid sequence | Position of the peptide in the ACT protein(s) |
|---|---|---|
| SEQ ID No. 840 | QWQGIR | 121-126 for the proteins of SEQ No. 788, 789, 794; 120-125 for the proteins of sequence SEQ ID No. 790, 791, 792, 793 |
| SEQ ID No. 841 | YWPELTGK | 113-120 for the proteins of SEQ No. 788, 789, 794; 112-119 for the proteins of sequence SEQ ID No. 790, 791 |

The detection of a mechanism of resistance to cephalosporins induced by the expression of the CARB protein is characterised by the detection of at least one peptide belonging to the CARB protein and to its different sequence variants SEQ ID No. 842 to SEQ ID No. 852.

SEQ ID No. 842:
MLLYKMCDNQNYGVTYMKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID No. 843:
MLLYKMCDNQNYGVTYMKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKLLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID No. 844:
MKLLLVFSLLIPSMVFANSSKFQQVEQDAKVIEASLSAHIGISVLDTQTGEYWDYNGNQRFPLTSTFKTIACAKLLYDAEQGEINPKSTIEIKKADLVTYSPVIEKQVGQAITLDDACFATMTTSDNAAANIILNALGGPESVTDFLRQIGDKETRLDRIEPELNEGKLGDLRDTTTPNAIVNTLNELLFGSTLSQDGQKKLEYWMVNNQVTGNLLRSVLPEGWNIADRSGAGGFGARSITAVVWSEAQSPIIVSIYLAQTEASIADRNDAIVKIGRSIFEVYSSQSR

SEQ ID No. 845:
MKFLLAFSLLIPSVVFASSSKFQQVEQDVKAIEVSLSARIGVSVLDTQNGEYWDYNGNQRFPLTSTEKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNQLLFGSTLSEASQKKLESWMVNNQVTGNLLRSVLPVKWSIADRSGAGGFGARSITAIVWSEEKKTIIVSIYLAQTEASMAERNDAIVKIGRSIFEVYTSQSR

SEQ ID No. 846:
MNVRKHKASFFSVVITFLCLTLSLNANATDSVLEAVTNAETELGARIGLAVHDLETGKRWEHKSNERFPLSSTFKTLACANVLQRVDLGKERIDRVVRFSESNLVTYSPVTEKHVGKKGMSLAELCQATLSTSDNSAANFILQAIGGPKALTKFLRSIGDDTTRLDRWETELNEAVPGDKRDTTTPIAMVTTLEKLLIDETLSIKSRQQLESWLKGNEVGDALFRKGVPSDWIVADRTGAGGYGSRAITAVMWPPNRKPIVAALYITETDASFEERNAVIAKIGEQIAKTVLMENSRN

SEQ ID No. 847:
MKFLLAFSLLIPSVVFASSSKFQQVEQDVKAIEVSLSARIGVSVLDTQNGEYWDYNGNQRFPLTSTFKTIACAKLLYDAEQGKVNSNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID No. 848:
MKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMEERNDAIVKIGHSIFDVYTSQSR

SEQ ID No. 849:
MKSLLVFALLMPSVVFASSSKFQSVEQEIKGIESSLSARIGVAILDTQNGESWDYNGDQRFPLTSTFKTIACAKLLYDAEHGKVNLNSTVEIKKADLVTYSPVLEKQVGKPITLSDACLATMTTSDNTAANIVINAVGDPKSITDFLRQIGDKETRLDRVEPELNEGKLGDLRDTTTPNAITSTLNQLLFGSTLSEASQKKLESWMVNNQVTGNLLRSVLPVKWSIADRSGAGGFGARSITAIVWSEEKKPIIVSIYLAQTEASMAERNDAIVKIGRSIFEVYTSQSR

SEQ ID No. 850:
MDVRKHKASFFSWITFLCLTLSLNANATDSVLEAVTNAETELGARIGLAVHDLETGKRWEHKSNERFPLSSTFKTLACANVLQRVDLGKERIDRVVRFSESNLVTYSPVTEKHVGKKGMSLAELCQATLSTSDNSAANFILQAIGGPKALTKFLRSIGDDTTRLDRWETELNEAVPGDKRDTTTPIAMVTTLEKLLIDETLSIKSRQQLESWLKGNEVGDALFRKGVPSDWIVADRTGAGGYGSRAITAVMWPPNRKPIVAALYITETDASFEERNAVIAKIGEQIAKTILMENSRN

-continued

SEQ ID No. 851:
MKSLLVFALLMPSVVFASSSKFQSVEQEIKGIESSLSARIGVAILDTQNG

ESWDYNGDQRFPLTSTFKTIACAKLLYDAEHGKVNLNSTVEVKKADLVTY

SPVLEKQVGKPITLSDACFATMTTSDNTAANIVINAVGDPKSITDFLRQI

GDKETRLDRVEPELNEGKLGDLRDTTTPNAITSTLNQLLFGSTLSEASQK

KLESWMVNNQVTGNLLRSVLPVTWSIADRSGAGGFGARSITAIVWSEEKK

PIIVSIYLAQTEASMAERNDAIVKIGRSIFEVYTSQSR

-continued

SEQ ID No. 852:
MKFLLVFSLLIPSVVFASSSKFRQVEQDVKAIEVSLSARIGVSVLDTQNG

EYWDYNGNQRFPLTSTFKTIACAKLLYDAEQGKVNPNSTVEIKKADLVTY

SPVIEKQVGQAITLDDACFATMTTSDNTAANIILSAVGGSKGVTDFLRQI

GDKETRLDRIEPDLNEGKLGDLRDTTTPKAIASTLNKFLFGSALSEMNKK

KLESWMVNNQVTGNLLRSVLPAGWNIADRSGAGGFGARSITAVVWSEHQA

PIIVSIYLAQTQASMAERNDAIVKIGRSIFDVYTSQSR said peptides being chosen, preferably, from the peptides of sequence SEQ ID No. 853 to SEQ ID No. 921 as defined hereafter:

| Peptide SEQ ID No. | Amino acid sequence | Position of the peptide in the CARB protein(s) |
|---|---|---|
| SEQ ID No. 853 | ADLVTYSPVIEK | 95-106 for the proteins of SEQ No. 844, 845, 847, 848, 852; 111-122 for the protein of sequence SEQ ID No. 842; 111-122 for the protein of sequence SEQ ID No. 843 |
| SEQ ID No. 854 | ADLVTYSPVLEK | 95-106 for the proteins of SEQ No. 849, 851 |
| SEQ ID No. 855 | AIASTLNK | 180-187 for the proteins of SEQ No. 847, 848, 852; 196-203 for the protein of sequence SEQ ID No. 842; 196-203 for the protein of sequence SEQ ID No. 843 |
| SEQ ID No. 856 | AIASTLNQLLFGSTLSEASQK | 180-200 for the protein of SEQ No. 845 |
| SEQ ID No. 857 | AIEVSLSAR | 31-39 for the proteins of SEQ No. 845, 847, 848, 852; 47-55 for the protein of sequence SEQ ID No. 842; 47-55 for the protein of sequence SEQ ID No. 843 |
| SEQ ID No. 858 | AITAVMWPPNR | 247-257 for the proteins of SEQ No. 846, 850 |
| SEQ ID No. 859 | DTTTPIAMVTTLEK | 182-195 for the proteins of SEQ No. 846, 850 |
| SEQ ID No. 860 | DTTTPK | 174-179 for the proteins of SEQ No. 845, 847, 848, 852; 190-195 for the protein of sequence SEQ ID No. 842; 190-195 for the protein of sequence SEQ ID No. 843 |
| SEQ ID No. 861 | FLFGSALSEMNK | 188-199 for the proteins of SEQ No. 852 |
| SEQ ID No. 862 | FLFGSALSEMNQK | 188-200 for the proteins of SEQ No. 847, 848; 204-216 for the protein of sequence SEQ ID No. 842 |
| SEQ ID No. 863 | FLLAFSLLIPSVVFASSSK | 3-21 for the proteins of SEQ No. 845, 847, 848; 19-37 for the protein of sequence SEQ ID No. 842; 19-37 for the protein of sequence SEQ ID No. 843 |
| SEQ ID No. 864 | FLLVFSLLIPSVVFASSSK | 3-21 for the protein of SEQ No. 852 |
| SEQ ID No. 865 | FPLSSTFK | 68-75 for the proteins of SEQ No. 846, 850 |
| SEQ ID No. 866 | FPLTSTFK | 61-68 for the proteins of SEQ No. 844, 845, 847, 848, 849, 851, 852; 77-84 for the protein of sequence SEQ ID No. 842; 77-84 for the protein of sequence SEQ ID No. 843 |
| SEQ ID No. 867 | FQQVEQDAK | 22-30 for the protein of SEQ No. 844 |

-continued

| Peptide SEQ ID No. | Amino acid sequence | Position of the peptide in the CARB protein(s) |
|---|---|---|
| SEQ ID No. 868 | FQQVEQDAK | 22-30 for the proteins of SEQ No. 845, 847, 848; 38-46 for the protein of sequence SEQ ID No. 842; 38-46 for the protein of sequence SEQ ID No. 843 |
| SEQ ID No. 869 | FQSVEQEIK | 22-30 for the proteins of SEQ No. 849, 851 |
| SEQ ID No. 870 | FSESNLVTYSPVTEK | 99-113 for the proteins of SEQ No. 846, 850 |
| SEQ ID No. 871 | GIESSLSAR | 31-39 for the proteins of SEQ No. 849, 851 |
| SEQ ID No. 872 | GNEVGDALFR | 216-225 for the proteins of SEQ No. 846, 850 |
| SEQ ID No. 873 | GVPSDWIVADR | 227-237 for the proteins of SEQ No. 846, 850 |
| SEQ ID No. 874 | GVTDFLR | 142-148 for the proteins of SEQ No. 845, 847, 848, 852; 158-164 for the protein of sequence SEQ ID No. 842; 158-164 for the protein of sequence SEQ ID No. 843 |
| SEQ ID No. 875 | IEPDLNEGK | 160-168 for the proteins of SEQ No. 845, 847, 848, 852; 176-184 for the protein of sequence SEQ ID No. 842; 176-184 for the protein of sequence SEQ ID No. 843 |
| SEQ ID No. 876 | IEPELNEGK | 160-168 for the protein of SEQ No. 844 |
| SEQ ID No. 877 | IGEQIAK | 283-289 for the proteins of SEQ No. 846, 850 |
| SEQ ID No. 878 | IGLAVHDLETGK | 47-58 for the proteins of SEQ No. 846, 850 |
| SEQ ID No. 879 | IGVAILDTQNGESWDYNGDQR | 40-60 for the proteins of SEQ No. 849, 851 |
| SEQ ID No. 880 | IGVSVLDTQNGEYWDYNGNQR | 40-60 for the proteins of SEQ No. 845, 847, 848, 852; 56-76 for the protein of sequence SEQ ID No. 842; 56-76 for the protein of sequence SEQ ID No. 843 |
| SEQ ID No. 881 | KPIIVSIYLAQTEASMAER | 250-268 for the proteins of SEQ No. 849, 851 |
| SEQ ID No. 882 | KPIVAALYITETDASFEER | 258-276 for the proteins of SEQ No. 846, 850 |
| SEQ ID No. 883 | LESWMVNNQVTGNLLR | 202-217 for the proteins of SEQ No. 845, 847, 848, 849, 851, 852; 218-233 for the protein of sequence SEQ ID No. 842; 218-233 for the protein of sequence SEQ ID No. 843 |
| SEQ ID No. 884 | LEYWMVNNQVTGNLLR | 202-217 for the protein of SEQ No. 844 |
| SEQ ID No. 885 | LGDLR | 169-173 for the proteins of SEQ No. 844, 845, 847, 848, 849, 851, 852; 185-189 for the protein of sequence SEQ ID No. 842; 185-189 for the protein of sequence SEQ ID No. 843 |
| SEQ ID No. 886 | LLFGSALSEMNQK | 204-216 for the protein of SEQ No. 843 |
| SEQ ID No. 887 | LLIDETLSIK | 196-205 for the proteins of SEQ No. 846, 850 |

-continued

| Peptide SEQ ID No. | Amino acid sequence | Position of the peptide in the CARB protein(s) |
|---|---|---|
| SEQ ID No. 888 | LLLVFSLLIPSMVFANSSK | 3-21 for the protein of SEQ No. 844 |
| SEQ ID No. 889 | LLYDAEHGK | 75-83 for the proteins of SEQ No. 849, 851 |
| SEQ ID No. 890 | LLYDAEQGEINPK | 75-87 for the protein of SEQ No. 844 |
| SEQ ID No. 891 | LLYDAEQGK | 75-83 for the proteins of SEQ No. 845, 847, 848, 852; 91-99 for the protein of sequence SEQ ID No. 842; 91-99 for the protein of sequence SEQ ID No. 843 |
| SEQ ID No. 892 | MCDNQNYGVTYMK | 6-18 for the proteins of SEQ No. 842, 843 |
| SEQ ID No. 893 | NAVIAK | 277-282 for the proteins of SEQ No. 846, 850 |
| SEQ ID No. 894 | NDAIVK | 269-274 for the proteins of SEQ No. 844, 845, 847, 848, 849, 851, 852; 285-290 for the protein of sequence SEQ ID No. 842; 285-290 for the protein of sequence SEQ ID No. 843 |
| SEQ ID No. 895 | QIGDK | 149-153 for the proteins of SEQ No. 844, 845, 847, 848, 849, 851, 852; 165-169 for the protein of sequence SEQ ID No. 842; 165-169 for the protein of sequence SEQ ID No. 843 |
| SEQ ID No. 896 | QQLESWLK | 208-215 for the proteins of SEQ No. 846, 850 |
| SEQ ID No. 897 | QVEQDVK | 24-30 for the proteins of SEQ No. 845, 847, 848, 852; 40-46 for the protein of sequence SEQ ID No. 842; 40-46 for the protein of sequence SEQ ID No. 843 |
| SEQ ID No. 898 | SGAGGFGAR | 230-238 for the proteins of SEQ No. 844, 845, 847, 848, 849, 851, 852; 246-254 for the protein of sequence SEQ ID No. 842; 246-254 for the protein of sequence SEQ ID No. 843 |
| SEQ ID No. 899 | SIGDDTTR | 157-164 for the proteins of SEQ No. 846, 850 |
| SEQ ID No. 900 | SITAIVWSEEK | 239-249 for the proteins of SEQ No. 845, 849, 851 |
| SEQ ID No. 901 | SITDFLR | 142-148 for the proteins of SEQ No. 849, 851 |
| SEQ ID No. 902 | SLLVFALLMPSVVFASSSK | 3-21 for the proteins of SEQ No. 849, 851 |
| SEQ ID No. 903 | STIEIK | 88-93 for the protein of SEQ No. 844 |
| SEQ ID No. 904 | SVLPAGWNIADR | 218-229 for the proteins of SEQ No. 847, 848, 852; 234-245 for the protein of sequence SEQ ID No. 842; 234-245 for the protein of sequence SEQ ID No. 843 |
| SEQ ID No. 905 | SVLPEGWNIADR | 218-229 for the protein of SEQ No. 844 |
| SEQ ID No. 906 | SVLPVK | 218-223 for the proteins of SEQ No. 845, 849 |
| SEQ ID No. 907 | SVLPVTWSIADR | 218-229 for the protein of SEQ No. 851 |

| Peptide SEQ ID No. | Amino acid sequence | Position of the peptide in the CARB protein(s) |
|---|---|---|
| SEQ ID No. 908 | TGAGGYGSR | 238-246 for the proteins of SEQ No. 846, 850 |
| SEQ ID No. 909 | TIACAK | 69-74 for the proteins of SEQ No. 844, 845, 847, 848, 849, 851, 852; 85-90 for the protein of sequence SEQ ID No. 842; 85-90 for the protein of sequence SEQ ID No. 843 |
| SEQ ID No. 910 | TIIVSIYLAQTEASMAER | 251-268 for the protein of SEQ No. 845 |
| SEQ ID No. 911 | TILMENSR | 290-297 for the protein of SEQ No. 850 |
| SEQ ID No. 912 | TLACANVLQR | 76-85 for the proteins of SEQ No. 846, 850 |
| SEQ ID No. 913 | TVLMENSR | 290-297 for the protein of SEQ No. 846 |
| SEQ ID No. 914 | VDLGK | 86-90 for the proteins of SEQ No. 846, 850 |
| SEQ ID No. 915 | VEPELNEGK | 160-168 for the proteins of SEQ No. 849, 851 |
| SEQ ID No. 916 | VNLNSTVEIK | 84-93 for the protein of SEQ No. 849 |
| SEQ ID No. 917 | VNLNSTVEVK | 84-93 for the protein of SEQ No. 851 |
| SEQ ID No. 918 | VNPNSTVEIK | 84-93 for the proteins of SEQ No. 845, 848, 852; 100-109 for the protein of sequence SEQ ID No. 842; 100-109 for the protein of sequence SEQ ID No. 843 |
| SEQ ID No. 919 | VNSNSTVEIK | 84-93 for the protein of SEQ No. 847 |
| SEQ ID No. 920 | WETELNEAVPGDK | 168-180 for the proteins of SEQ No. 846, 850 |
| SEQ ID No. 921 | WSIADR | 224-229 for the proteins of SEQ No. 845, 849, 851 |

The detection of a mechanism of resistance to cephalosporins induced by the expression of the DHA protein is characterised by the detection of at least one peptide belonging to the DHA protein and to its different sequence variants SEQ ID No. 922 to SEQ ID No. 927.

SEQ ID No. 922:
MKKSLSATLISALLAFSAPGFSAADNVAAVVDSTIKPLMAQQDIPGMAVA

VSVKGKPYYFNYGFADVQAKQPVTENTLFELGSVSKTFTGVLGAVSVAKK

EMMLNDPAEKYQPELALPQWKGITLLDLATYTTGGLPLQVPDAVKNRAEL

LHFYQQWQPSRKPGDMRLYANSSIGLFGALTANAAGMPYEQLLTARILAP

LGLSHTFITVPESAQSQYAYGYKNKKPVRVSPGQLDAESYGVKSASKDML

RWAEMNMEPSRAGNADLEMAMYLAQTRYYKTAAINQGLGWEMYDWPQQKD

MIINGVTNEVALQPHPVTDNQVQPYNRASWVHKTGATTGFGAYVAFIPEK

QVAIVILANKNYPNTERVKAAQAILSALE

SEQ ID No. 923:
MKKSLSATLISALLAFSAPGFSAADNVAAVVDSTIKPLMAQQDIPGMAVA

VSVKGKPYYFNYGFADIQAKQPVTENTLFELGSVSKTFTGVLGAVSVAKK

EMALNDPAAKYQPELALPQWKGITLLDLATYTAGGLPLQVPDAVKSRADL

LNFYQQWQPSRKPGDMRLYANSSIGLFGALTANAAGMPYEQLLTARILAP

LGLSHTFITVPDSAQSQYAYGYKNKKPVRVSPGQLDAESYGVKSASKDML

RWAEMNIEPSRAGNADLEMAMYLAQTRYYKTAAINQGLGWEMYDWPQQKD

MIINGVTNEVALQPHPVTDNQVQPYNRASWVHKTGATTGFGAYVAFIPEK

QVAIVILANKNYPNTERVKAAQAILSALE

SEQ ID No. 924:
MKKSLSATLISALLAFSAPGFSAADNVAAVVDSTIKPLMAQQDIPGMAVA

VSVKGKPYYFNYGFADIQAKQPVTENTLFELGSVSKTFTGVLGAVSVAKK

EMALNDPAAKYQPELALPQWKGITLLDLATYTAGGLPLQVPDAVKSRADL

LNFYQQWQPSRKPGDMRLYANSSIGLFGALTANAAGMPYEQLLTARILAP

-continued
LGLSHTFITVPESAQSQYAYGYKNKKPVRVSPGQLDAESYGVKSASKDML

RWAEMNMEPSRAGNADLEMAMYLAQTRYYKTAAINQGLGWEMYDWPQQKD

MIINGVTNEVALQPHPVTDNQVQPYNRASWVHKTGATTGSGAYVAFIPEK

QVAIVILANKNYPNTERVKAAQAILSALE

SEQ ID No. 925:
MKKSLSATLISALLAFSAPGFSAADNVAAVVDSTIKPLMAQQDIPGMAVA

VSVKGKPYYFNYGFADIQAKQPVTENTLFELGSVSKTFTGVLGAVSVAKK

EMALNDPAAKYQPELALPQWKGITLLDLATYTAGGLPLQVPDAVKSRADL

LNFYQQWQPSRKPGDMRLYANSSIGLFGALTANAAGMPYEQLLTARILAP

LGLSHTFITVPESAQSQYAYGYKNKKPVRVSPGQLDAESYGVKSTSKDML

RWAEMNMEPSRAGNADLEMAMYLAQTRYYKTAAINQGLGWEMYDWPQQKD

MIINGVTNEVALQPHPVTDNQVQPYNRASWVHKTGATTGFGAYVAFIPEK

QVAIVILANKNYPNTERVKAAQAILSALE

SEQ ID No. 926:
MKKSLSATLISALLAFSAPGFSAADNVAAVVDSTIKPLMAQQDIPGMAVA

VSVKGRPYYFNYGFADVQAKQPVTENTLFELGSVSKTFTGVLGAVSVAKK

EMALNDPAAKYQPELALPQWKGITLLDLATYTAGGLPLQVPDAVKSRADL

-continued
LHFYQQWQPSRKPGDMRLYANSSIGLFGALTANAAGMPYEQLLTARILAP

LGLSHTFITVPESAQSQYAYGYKNKKPVRVSPGQLDAESYGVKSASKDML

RWAEMNMEPSRAGNADLEMAMYLAQTRYYKTAAINQGLGWEMYDWPQQKD

MIINGVTNEVALQPHPVTDNQVQPYNRASWVHKTGATTGFGAYVAFIPEK

QVAIVILANKNYPNTERVKAAQAILSALE

SEQ ID No. 927:
MKKSLSATLISALLAFSAPGFSAADNVAAVVDSTIKPLMAQQDIPGMAVA

VSVKGKPYYFNYGFADIQAKQPVTENTLFELGSVSKTFTGVLGAVSVAKK

EMALNDPAAKYQPELALPQWKGITLLDLATYTAGGLPLQVPDAVKSRADL

LNFYQQWQPSRKPGDMRLYANSSIGLFGALTANAAGMPYEQLLTARILAP

LGLSHTFITVPESAQSQYAYGYKNKKPVRVSPGQLDAESYGVKSASKDML

RWAEMNMEPSRAGNADLEMAMYLAQTRYYKTAAINQGLGWEMYDWPQQKD

MIINGVTNEVALQPHPVTDNQVQPYNRASWVHKTGATTGFGAYVAFIPEK

QVAIVILANKNYPNTERVKAAQAILSALE said peptides being chosen, preferably, from the peptides of sequence SEQ ID No. 928 to SEQ ID No. 948 as defined hereafter:

| Peptide SEQ ID No. | Amino acid sequence | Position of the peptide in the DHA protein(s) |
|---|---|---|
| SEQ ID No. 928 | ADLLHFYQQWQPSR | 148-161 for the protein of SEQ No. 926 |
| SEQ ID No. 929 | ADLLNFYQQWQPSR | 148-161 for the proteins of SEQ No. 923, 924, 925, 927 |
| SEQ ID No. 930 | AELLHFYQQWQPSR | 148-161 for the protein of SEQ No. 922 |
| SEQ ID No. 931 | AGNADLEMAMYLAQTR | 262-277 for the proteins of SEQ No. 922, 923, 924, 925, 926, 927 |
| SEQ ID No. 932 | EMALNDPAAK | 101-110 for the proteins of SEQ No. 923, 924, 925, 926, 927 |
| SEQ ID No. 933 | EMMLNDPAEK | 101-110 for the protein of SEQ No. 922 |
| SEQ ID No. 934 | GKPYYFNYGFADIQAK | 55-70 for the proteins of SEQ No. 923, 924, 925, 927 |
| SEQ ID No. 935 | GKPYYFNYGFADVQAK | 55-70 for the protein of SEQ No. 922 |
| SEQ ID No. 936 | KPGDMR | 162-167 for the proteins of SEQ No. 922, 923, 924, 925, 926, 927 |
| SEQ ID No. 937 | NYPNTER | 361-367 for the proteins of SEQ No. 922, 923, 924, 925, 926, 927 |
| SEQ ID No. 938 | QPVTENTLFELGSVSK | 71-86 for the proteins of SEQ No. 922, 923, 924, 925, 926, 927 |
| SEQ ID No. 939 | QVAIVILANK | 351-360 for the proteins of SEQ No. 922, 923, 924, 925, 926, 927 |
| SEQ ID No. 940 | TAAINQGLGWEMYDWPQQK | 281-299 for the proteins of SEQ No. 922, 923, 924, 925, 926, 927 |
| SEQ ID No. 941 | TFTGVLGAVSVAK | 87-99 for the proteins of SEQ No. 922, 923, 924, 925, 926, 927 |

| Peptide SEQ ID No. | Amino acid sequence | Position of the peptide in the DHA protein(s) |
|---|---|---|
| SEQ ID No. 942 | TGATTGFGAYVAFIPEK | 334-350 for the proteins of SEQ No. 922, 923, 925, 926, 927 |
| SEQ ID No. 943 | TGATTGSGAYVAFIPEK | 334-350 for the protein of SEQ No. 924 |
| SEQ ID No. 944 | VSPGQLDAESYGVK | 230-243 for the proteins of SEQ No. 922, 923, 924, 925, 926, 927 |
| SEQ ID No. 945 | WAEMNIEPSR | 252-261 for the protein of SEQ No. 923 |
| SEQ ID No. 946 | WAEMNMEPSR | 252-261 for the proteins of SEQ No. 922, 924, 925, 926, 927 |
| SEQ ID No. 947 | YQPELALPQWK | 111-121 for the proteins of SEQ No. 922, 923, 924, 925, 926, 927 |
| SEQ ID No. 948 | ASWVHK | 328-333 for the proteins of SEQ No. 922, 923, 924, 925, 926, 927 |

The detection of a mechanism of resistance to cephalosporins induced by the expression of the MIR protein is characterised by the detection of at least one peptide belonging to the MIR protein and to its different sequence variants SEQ ID No. 949 to SEQ ID No. 953.

SEQ ID No. 949:
MMTKSLSCALLLSVASSAFAAPMSEKQLAEVVERTVTPLMNAQAIPGMAV

AVIYQGQPHYFTFGKADVAANKPVTPQTLFELGSISKTFTGVLGGDAIAR

GEIALGDPVAKYWPELTGKQWQGIRMLDLATYTAGGLPLQVPDEVTDTAS

LLRFYQNWQPQWKPGTTRLYANASIGLFGALAVKPSGMSYEQAMTTRVFK

PLKLDHTWINVPKAEEAHFAWGYREGKAVHVSPGMLDAEAYGVKTNVKDM

ASWLIANMKPDSLQAPSLKQGIALAQSRYWRVGAMYQGLGWEMLNWPVDA

KTVVGGSDNKVALAPLPVAEVNPPAPPVKASWVHKTGSTGGFGSYVAFIP

EKQLGIVMLANKSYPNPARVEAAYRILDALQ

SEQ ID No. 950:
MMTKSLSCALLLSVASAAFAAPMSETQLAEVVERTVTPLMNAQAIPGMAV

AVIYQGQPHYFTFGKADVAANKPVTPQTLFELGSISKTFTGVLGGDAIAR

GEIALGDPVAKYWPELTGKQWQGIRMLDLATYTAGGLPLQVPDEVTDTAS

LLRFYQNWQPQWKPGTTRLYANASIGLFGALAVKPSGMSYEQAMTTRVFK

PLKLDHTWINVPKAEEAHYAWGYREGKAVHVSPGMLDAEAYGVKTNVKDM

ASWVIANMKPDSLQAPSLKQGIALAQSRYWRVGAMYQGLGWEMLNWPVDA

KTVVGGSDNKVALAPLPVAEVNPPAPPVKASWVHKTGSTGGFGSYVAFIP

EKQLGIVMLANKSYPNPARVEAAYHILDALQ

SEQ ID No. 951:
MMTKSLSCALLLSVASAAFAAPMSEKQLAEVVERTVTPLMNAQAIPGMAV

AVIYQGQPHYFTFGKADVAANKPVTPQTLFELGSISKTFTGVLGGDAIAR

GEIALGDPVAKYWPELTGKQWQGIRMLDLATYTAGGLPLQVPDEVTDTAS

LLRFYQNWQPQWKPGTTRLYANASIGLFGALAVKPSGMSYEQAMTTRVFK

PLKLDHTWINVPKAEEAHYAWGYREGKAVHVSPGMLDAEAYGVKTNVKDM

ASWLIANMKPDSLHAPSLKQGIALAQSRYWRVGAMYQGLGWEMLNWPVDA

KTVVGGSDNKVALAPLPVAEVNPPAPPVKASWVHKTGSTGGFGSYVAFIP

EKQLGIVMLANKSYPNPARVEAAYRILDALQ

SEQ ID No. 952:
MMTKSLSCALLLSVASAAFAAPMFEKQLAEVVERTVTPLMNAQAIPGMAV

AVIYQGQPHYFTFGKADVAANKPVTPQTLFELGSISKTFTGVLGGDAIAR

GEIALGDPVAKYWPELTGKQWQGIRMLDLATYTAGGLPLQVPDEVTDTAS

LLRFYQNWQPQWKPGTTRLYANASIGLFGALAVKPSGMSYEQAMTTRVFK

PLKLDHTWINVPKAEEAHYAWGYREGKAVHVSPGMLDAEAYGVKTNVKDM

ASWLIANMKPDSLHAPSLKQGIALAQSRYWRVGAMYQGLGWEMLNWPVDA

KTVVGGSDNKVALAPLPVAEVNPPAPPVKASWVHKTGSTGGFGSYVAFIP

EKQLGIVMLANKSYPNPARVEAAYRILDALQ

SEQ ID No. 953:
MMTKSLSCALLLSVASAAFAAPMSEKQLAEVVERTVTPLMNAQAIPGMAV

AVIYQGQPHYFTFGKADVAANKPVTPQTLFELGSISKTFTGVLGGDAIAR

GEIALGDPVAKYWPELTGKQWQGIRMLDLATYTAGGLPLQVPDEVTDTAS

LLRFYQNWQPQWKPGTTRLYANASIGLFGALAVKPSGMSYEQAMTTRVFK

PLKLDHTWINVPKAEEAHYAWGYREGKAVHVSPGMLDAEAYGVKTNVKDM

ASWLIANMKPDSLQAPSLKQGIALAQSRYWRVGAMYQGLGWEMLNWPVDA

KTVVGGSDNKVALAPLPVAEVNPPAPPVKASWVHKTGSTGGFGSYVAFIP

EKQLGIVMLANKSYPNPARVEAAYRILDALQ said peptides being chosen, preferably, from the peptides of sequence SEQ ID No. 954 to SEQ ID No. 981 as defined hereafter:

| Peptide SEQ ID No. | Amino acid sequence | Position of the peptide in the MIR protein(s) |
|---|---|---|
| SEQ ID No. 954 | AEEAHFAWGYR | 214-224 for the protein of SEQ No. 949 |
| SEQ ID No. 955 | DMASWLIANMK | 249-259 for the proteins of SEQ No. 949, 951, 952, 953 |
| SEQ ID No. 956 | DMASWLIANMKPDSLHAPSLK | 249-269 for the proteins of SEQ No. 951, 952 |
| SEQ ID No. 957 | DMASWLIANMKPDSLQAPSLK | 249-269 for the proteins of SEQ No. 949, 953 |
| SEQ ID No. 958 | DMASWVIANMK | 249-259 for the protein of SEQ No. 950 |
| SEQ ID No. 959 | DMASWVIANMKPDSLQAPSLK | 249-269 for the protein of SEQ No. 950 |
| SEQ ID No. 960 | GEIALGDPVAK | 101-111 for the proteins of SEQ No. 949, 950, 951, 952, 953 |
| SEQ ID No. 961 | TVVGGSDNK | 302-310 for the proteins of SEQ No. 949, 950, 951, 952, 953 |
| SEQ ID No. 962 | ADVAANK | 66-72 for the proteins of SEQ No. 949, 950, 951, 952, 953 |
| SEQ ID No. 963 | AEEAHYAWGYR | 214-224 for the proteins of SEQ No. 950, 951, 952, 953 |
| SEQ ID No. 964 | AVHVSPGMLDAEAYGVK | 228-244 for the proteins of SEQ No. 949, 950, 951, 952, 953 |
| SEQ ID No. 965 | FYQNWQPQWK | 154-163 for the proteins of SEQ No. 949, 950, 951, 952, 953 |
| SEQ ID No. 966 | FYQNWQPQWKPGTTR | 154-168 for the proteins of SEQ No. 949, 950, 951, 952, 953 |
| SEQ ID No. 967 | LDHTWINVPK | 204-213 for the proteins of SEQ No. 949, 950, 951, 952, 953 |
| SEQ ID No. 968 | LYANASIGLFGALAVK | 169-184 for the proteins of SEQ No. 949, 950, 951, 952, 953 |
| SEQ ID No. 969 | QGIALAQSR | 270-278 for the proteins of SEQ No. 949, 950, 951, 952, 953 |
| SEQ ID No. 970 | QLAEVVER | 27-34 for the proteins of SEQ No. 949, 950, 951, 952, 953 |
| SEQ ID No. 971 | QLGIVMLANK | 353-362 for the proteins of SEQ No. 949, 950, 951, 952, 953 |
| SEQ ID No. 972 | SYPNPAR | 363-369 for the proteins of SEQ No. 949, 950, 951, 952, 953 |
| SEQ ID No. 973 | TFTGVLGGDAIAR | 88-100 for the proteins of SEQ No. 949, 950, 951, 952, 953 |
| SEQ ID No. 974 | TGSTGGFGSYVAFIPEK | 336-352 for the proteins of SEQ No. 949, 950, 951, 952, 953 |
| SEQ ID No. 975 | VALAPLPVAEVNPPAPPVK | 311-329 for the proteins of SEQ No. 949, 950, 951, 952, 953 |
| SEQ ID No. 976 | VEAAYR | 370-375 for the proteins of SEQ No. 949, 951, 952, 953 |
| SEQ ID No. 977 | VFKPLK | 198-203 for the proteins of SEQ No. 949, 950, 951, 952, 953 |
| SEQ ID No. 978 | VGAMYQGLGWEMLNWPVDAK | 282-301 for the proteins of SEQ No. 949, 950, 951, 952, 953 |
| SEQ ID No. 979 | ASWVHK | 330-335 for the proteins of SEQ No. 949, 950, 951, 952, 953 |

| Peptide SEQ ID No. | Amino acid sequence | Position of the peptide in the MIR protein(s) |
|---|---|---|
| SEQ ID No. 980 | QWQGIR | 120-125 for the proteins of SEQ No. 949, 950, 951, 952, 953 |
| SEQ ID No. 981 | YWPELTGK | 112-119 for the proteins of SEQ No. 949, 950, 951, 952, 953 |

The detection of a mechanism of resistance to cephalosporins induced by the expression of the MOX protein is characterised by the detection of at least one peptide belonging to the MOX protein and to its different sequence variants SEQ ID No. 982 to SEQ ID No. 988.

SEQ ID No. 982:
MQQRQSILWGAVATLMWAGLAHAGETSPVDPLRPVVDASIQPLLKEHRIP
GMAVAVLKDGKAHYFNYGVADRERAVGVSEQTLFEIGSVSKPLTATLGAY
AVVKGAMQLDDKASRHAPWLKGSAFDSITMGELATYSAGGLPLQFPEEVD
SLEKMQAYYRQWTPAYSPGSHRQYSNPSIGLFGHLAASSLKQPFAQLMEQ
TLLPGLGLHHTYVNVPKQAMASYAYGYSKEDKPIRVSPGMLADEAYGIKT
SSADLLRFVKANISGVDDKALQQAISLTHKGHYSVGGMTQGLGWERYAYP
VSEQTLLAGNSAKVILEANPTAAPRESGSQMLFNKTGSTSGFGAYVAFVP
AKGIGIVMLANRNYPIPARVKAAHAILTQLAR

SEQ ID No. 983:
MQQRQSILWGALATLMWAGLAHAGDTSAVDPLRPVVDASIRPLLKEHRIP
GMAVAVLKDGKAHYFNYGVADRERAVGVSEQTLFEIGSVSKPLTATLGAY
AVVKGAMQLDDKASRHAPWLKGSAFDSITMGELATYSAGGLPLQFPEEVD
SLEKMQAYYRQWTPAYSPGSHRQYSNPSIGLFGHLAASSMKQPFAQLMEQ
TLLPGLGLHHTYVNVPKQAMASYAYGYSKEDKPIRVSPGMLADEAYGIKT
SSADLLRFVKANISGVDDKALQQAISLTHKGHYSVGGMTQGLGWESYAYP
VSEQTLLAGNSAEVILEANPTAAPRESGNLMLFNKTGSTSGFGAYVAFVP
AKGIGIVMLANRNYPIPARVKAAHAILTQLAR

SEQ ID No. 984:
MQQRQSILWGALATLMWAGLAHAGDKAATDPLRPVVDASIRPLLKEHRIP
GMAVAVLKDGKAHYFNYGVADRERAVGVSEQTLFEIGSVSKTLTATLGAY
AVVQGGFELDDKASLFAPWLKGSAFDNITMGELATYSAGGLPLQFPEEVD
SLEKMQAYYRQWTPAYSRGSHRQYANPSIGLFGYLAASSMKQPFDRLMEQ
TMLPGLGLYHTYLNVPEQPMGHYAYGYWKEDKPFRVTPAMLAEEPYGIKT
SSADLLRFVKANISGVDNAAMQQAIDLTHQGQYAVGEMTQGLGWERYPYP
VSEQTLLAGNSPAMIYNANPAAPAPAAAGHPVLFKKTGSTNGFGAYVAFV
PAKGIGVVMLANRNYPNEGTLKAGHAILTQLAR

SEQ ID No. 985:
MQQRQSILWGVLPTLMWAGLAHAGDRAATDPLRPVVDASIRPLLKEHRIP
GMAVAVLKDGKAHYFNYGVADRERAVGVSEQTLFEIGSVSKTLTATLGAY
AVVQGSFELDDKASLFAPWLKGSVFDNITMGELATYSAGGLPLQFPEEVD
SLEKMQAYYRQWTPAYSPGSHRQYANPSIGLFGYLAASSMKQPFDRLMEQ
TILPGLGLYHTYLNVPEQAMGHYAYGYSKEDKPIRVTPGMLADEAYGIKT
SSADLLRFVKANISGVDNAAMQQAIDLTHQGQYAVGEMTQGLGWERYAYP
VSEQTLLAGNSAAMIYNANPAAPAPAARGHPVLFNKTGSTNGFGAYVAFV
PAKGIGIVMLANRNSPIEGTLKAGHAILTQLAR

SEQ ID No. 986:
MQQRQSILWGALATLMWAGLVHAGDKAATDPLRPVVDASIRPLLKEHRIP
GMAVAVLKDGKAHYFNYGVADRERAVGVSEQTLFEIGSVSKTLTATLGAY
AVVQGSFELDDKASLFAPWLKGSVFDNITMGELATYSAGGLPLQFPEEVD
SLEKMQAYYRQWTPAYSPGSHRQYANPSIGLFGYLAASSMKQPFDRLMEQ
TMLPGLGLYHTYLTVPEQAMGHYAYGYSKEDKPIRVTPGMLADEAYGIKT
SSADLLRFVKANIGGVDNAAMQQAIDLTHQGQYAVGEMTQGLGWERYAYP
VSEQTLLAGNSPAMIYNAIPAVPAPAAAGHPVLFNKTGSTNGFGAYVAFV
PAKGIGIVMLANRNSPIEARIKAAHAILTQLAR

SEQ ID No. 987:
MQQRQSILWGAVATLMWAGLAHAGEASPVDPLRPVVDASIQPLLKEHRIP
GMAVAVLKDGKAHYFNYGVANRESGASVSEQTLFEIGSVSKTLTATLGAY
AVVKGAMQLDDKASRHAPWLKGSVFDSITMGELATYSAGGLPLQFPEEVD
SSEKMRAYYRQWAPVYSPGSHRQYSNPSIGLFGHLAASSLKQPFAQLMEQ
TLLPGLGMHHTYVNVPKQAMASYAYGYSKEDKPIRVNPGMLADEAYGIKT
SSADLLAFVKANIGGVDDKALQQAISLTHKGHYSVGGMTQGLGWESYAYP
VTEQTLLAGNSAKVILEANPTAAPRESGSQVLFNKTGSSNGFGAYVAFVP
ARGIGIVMLANRNYPIPARVKAAHAILAQLAG

SEQ ID No. 988:
MQQRQSILWGALATLMWAGLAHAGETSPVDPLRPVVDASIRPLLKEHRIP
GMAVAVLKDGKAHYFNYGVADRERAVGVSEQTLFEIGSVSKPLTATLGAY
AVVKGAMQLDDKASRHAPWLKGSAFDSITMGELATYSAGGLPLQFPEEVD
SLEKMQAYYRQWTPAYSPGSHRQYSNPSIGLFGHLAASSMKQPFAQLMEQ
TLLPGLGLHHTYVNVPKQAMASYAYGYSKEDKPIRVSPGMLADEAYGIKT
SSADLLRFVKANISGVHDKALQQAISLTHKGHYSVGGMTQGLGWESYAYP
VSEQTLLAGNSAKVILEANPTAAPRESGSQMLFNKTGSTSGFGAYVAFVP
AKGIGIVMLANRNYPIPARVKAAHAILTQLAR said peptides being chosen, preferably, from the peptides of sequence SEQ ID No. 989 to SEQ ID No. 1037 as defined hereafter:

| Peptide SEQ ID No. | Amino acid sequence | Position of the peptide in the MOX protein(s) |
| --- | --- | --- |
| SEQ ID No. 989 | AATDPLR | 27-33 for the proteins of SEQ No. 984, 985, 986 |
| SEQ ID No. 990 | AHYFNYGVADR | 62-72 for the proteins of SEQ No. 982, 983, 984, 985, 986, 988 |
| SEQ ID No. 991 | ANISGVDDK | 261-269 for the proteins of SEQ No. 982, 983 |
| SEQ ID No. 992 | ANISGVHDK | 261-269 for the protein of SEQ No. 988 |
| SEQ ID No. 993 | ASLFAPWLK | 113-121 for the proteins of SEQ No. 984, 985, 986 |
| SEQ ID No. 994 | AVGVSEQTLFEIGSVSK | 75-91 for the proteins of SEQ No. 982, 983, 984, 985, 986, 988 |
| SEQ ID No. 995 | EDKPFR | 230-235 for the protein of SEQ No. 984 |
| SEQ ID No. 996 | ESGNLMLFNK | 326-335 for the protein of SEQ No. 983 |
| SEQ ID No. 997 | ESGSQMLFNK | 326-335 for the proteins of SEQ No. 982, 988 |
| SEQ ID No. 998 | GHPVLFNK | 329-336 for the proteins of SEQ No. 985, 986 |
| SEQ ID No. 999 | GHYSVGGMTQGLGWER | 281-296 for the protein of SEQ No. 982 |
| SEQ ID No. 1000 | GIGVVMLANR | 354-363 for the protein of SEQ No. 984 |
| SEQ ID No. 1001 | MQAYYR | 155-160 for the proteins of SEQ No. 982, 983, 984, 985, 986, 988 |
| SEQ ID No. 1002 | NSPIEAR | 364-370 for the protein of SEQ No. 986 |
| SEQ ID No. 1003 | NSPIEGTLK | 364-372 for the protein of SEQ No. 985 |
| SEQ ID No. 1004 | NYPNEGTLK | 364-372 for the protein of SEQ No. 984 |
| SEQ ID No. 1005 | QPFDR | 192-196 for the proteins of SEQ No. 984, 985, 986 |
| SEQ ID No. 1006 | QWTPAYSPGSHR | 161-172 for the proteins of SEQ No. 982, 983, 985, 986, 988 |
| SEQ ID No. 1007 | QWTPAYSR | 161-168 for the protein of SEQ No. 984 |
| SEQ ID No. 1008 | QYANPSIGLFGYLAASSMK | 173-191 for the proteins of SEQ No. 984, 985, 986 |
| SEQ ID No. 1009 | QYSNPSIGLFGHLAASSMK | 173-191 for the proteins of SEQ No. 983, 988 |
| SEQ ID No. 1010 | TGSSNGFGAYVAFVPAR | 336-352 for the protein of SEQ No. 987 |

-continued

| Peptide SEQ ID No. | Amino acid sequence | Position of the peptide in the MOX protein(s) |
|---|---|---|
| SEQ ID No. 1011 | TGSTNGFGAYVAFVPAK | 337-353 for the proteins of SEQ No. 984, 985, 986 |
| SEQ ID No. 1012 | TGSTSGFGAYVAFVPAK | 336-352 for the proteins of SEQ No. 982, 983, 988 |
| SEQ ID No. 1013 | TLTATLGAYAVVQGGFELDDK | 92-112 for the protein of SEQ No. 984 |
| SEQ ID No. 1014 | TLTATLGAYAVVQGSFELDDK | 92-112 for the proteins of SEQ No. 985, 986 |
| SEQ ID No. 1015 | VSPGMLADEAYGIK | 236-249 for the proteins of SEQ No. 982, 983, 988 |
| SEQ ID No. 1016 | VTPAMLAEEPYGIK | 236-249 for the protein of SEQ No. 984 |
| SEQ ID No. 1017 | VTPGMLADEAYGIK | 236-249 for the proteins of SEQ No. 985, 986 |
| SEQ ID No. 1018 | YAYPVSEQTLLAGNSAK | 297-313 for the proteins of SEQ No. 982, 988 |
| SEQ ID No. 1019 | ALQQAISLTHK | 270-280 for the proteins of SEQ No. 982, 983, 987, 988 |
| SEQ ID No. 1020 | ANIGGVDDK | 261-269 for the protein of SEQ No. 987 |
| SEQ ID No. 1021 | EDKPIR | 230-235 for the proteins of SEQ No. 982, 983, 985, 986, 987, 988 |
| SEQ ID No. 1022 | ESGASVSEQTLFEIGSVSK | 73-91 for the protein of SEQ No. 987 |
| SEQ ID No. 1023 | ESGSQVLFNK | 326-335 for the protein of SEQ No. 987 |
| SEQ ID No. 1024 | GAMQLDDK | 105-112 for the proteins of SEQ No. 982, 983, 987, 988 |
| SEQ ID No. 1025 | GIGIVMLANR | 353-362 for the proteins of SEQ No. 982, 983, 987, 988; 354-363 for the proteins of sequence SEQ ID No. 985, 986 |
| SEQ ID No. 1026 | HAPWLK | 116-121 for the proteins of SEQ No. 982, 983, 987, 988 |
| SEQ ID No. 1027 | NYPIPAR | 363-369 for the proteins of SEQ No. 982, 983, 987, 988 |
| SEQ ID No. 1028 | QAMASYAYGYSK | 218-229 for the proteins of SEQ No. 982, 983, 987, 988 |
| SEQ ID No. 1029 | QWAPVYSPGSHR | 161-172 for the protein of SEQ No. 987 |

| Peptide SEQ ID No. | Amino acid sequence | Position of the peptide in the MOX protein(s) |
|---|---|---|
| SEQ ID No. 1030 | QYSNPSIGLFGHLAASSLK | 173-191 for the proteins of SEQ No. 982, 987 |
| SEQ ID No. 1031 | TLTATLGAYAVVK | 92-104 for the protein of SEQ No. 987 |
| SEQ ID No. 1032 | TSSADLLAFVK | 250-260 for the protein of SEQ No. 987 |
| SEQ ID No. 1033 | TSSADLLR | 250-257 for the proteins of SEQ No. 982, 983, 984, 985, 986, 988 |
| SEQ ID No. 1034 | VILEANPTAAPR | 314-325 for the proteins of SEQ No. 982, 983, 987, 988 |
| SEQ ID No. 1035 | VNPGMLADEAYGIK | 236-249 for the protein of SEQ No. 987 |
| SEQ ID No. 1036 | AHYFNYGVANR | 62-72 for the protein of SEQ No. 987 |
| SEQ ID No. 1037 | IPGMAVAVLK | 49-58 for the proteins of SEQ No. 982, 983, 984, 985, 986, 987, 988 |

The detection of a mechanism of resistance to cephalosporins induced by the expression of the PER protein is characterised by the detection of at least one peptide belonging to the PER protein and to its different sequence variants SEQ ID No. 1038 to SEQ ID No. 1044.

SEQ ID No. 1038:
MNVIIKAVVTASTLLMVSFSSFETSAQSPLLKEQIESIVIGKKATVGVAV
WGPDDLEPLLINPFEKFPMQSVFKLHLAMLVLHQVDQGKLDLNQTVIVNR
AKVLQNTWAPIMKAYQGDEFSVPVQQLLQYSVSLSDNVACDLLFELVGGP
AALHDYIQSMGIKETAVVANEAQMHADDQVQYQNWTSMKGAAEILKKFEQ
KTQLSETSQALLWKWMVETTTGPERLKGLLPAGTVVAHKTGTSGIKAGKT
AATNDLGIILLPDGRPLLVAVFVKDSAESSRTNEAIIAQVAQTAYQFELK
KLSALSPN

SEQ ID No. 1039:
MNVIIKAVVTASTLLMVSFSSFETSAQSPLLKEQIESIVIGKKATVGVAV
WGPDDLEPLLINPFEKFPMQSVFKLHLAMLVLHQVDQGKLDLNQTVIVNR
AKVLQNTWAPIMKAYQGDEFSVPVQQLLQYSVSHTDNVACDLLFELVGGP
AALHDYIQSMGIKETAVVANEAQMHADDQVQYQNWTSMKGAAEILKKFEQ
KTQLSETSQALLWKWMVETTTGPERLKGLLPAGTVVAHKTGTSGIKAGKT
AATNDLGIILLPDGRPLLVAVFVKDSAESSRTNEAIIAQVAQTAYQFELK
KLSALSPN

SEQ ID No. 1040:
MNVIIKAVVTASTLLMVSFSSFETSAQSPLLKGQIESIVIGKKATVGVAV
WGPDDLEPLLINPFEKFPMQSVFKLHLAMLVLHQVDQGKLDLNQTVIVNR
AKVLQNTWAPIMKAYQGDEFSVPVQQLLQYSVSHSDNVACDLLFELVGGP
AALHDYIQSMGIKETAVVANEAQMHADDQVQYQNWTSMKGAAEILKKFEQ
KTQLSETSQALLWKWMVETTTGPERLKGLLPAGTVVAHKTGTSGIKAGKT
AATNDLGIILLPDGRPLLVAVFVKDSAESSRTNEAIIAQVAQTAYQFELK
KLSALSPN

SEQ ID No. 1041:
MNVIAKGVFTTTALLMLSLSSWVVSAQSPLLKEQIETIVTGKKATVGVAV
WGPDDLEPLLVNPFEKFPMQSVFKMHLAMLVLHQVDQGKLDLNKTVAVNR
AAVLQNTWSPMMKDHQGDEFTVTVQQLLQYSVSHSDNVACDLLFELVGGP
AALHAYIQSLGIKETEVVANEAQMHADDQVQYKNWTSMKAAAQLLRKFEQ
KKQLSETSQALLWKWMVETTTGPQRLKGLLPAGTVVAHKTGTSGVRAGKT
AATNDIGVIMLPDGRPLLVAVFVKDSAESARTNEAIIAQVAQAAYQFELK
KLSAVSPD

SEQ ID No. 1042:
MNVIIKAVVTASTLLMVSFSSFETSAQSPLLKEQIESIVIGKKATVGVAV
WGPDDLEPLLINPFEKFPMQSVFKLHLAMLVLHQVDQGKLDLNQTVIVNR
AKVLQNTWAPIMKAYQGDQFSVPVQQLLQYSVSHSDNVACDLLFELVGGP
AALHDYIQSMGIKETAVVANEAQMHADDQVQYQNWTSMKGAAEILKKFEQ
KTQLSETSQALLWKWMVETTTGPERLKGLLPAGTVVAHKTGTSGVRAGKT

-continued

```
AATNDLGIILLPDGRPLLVAVFVKDSAESSRTNEAIIAQVAQAAYQFELK

KLSALSPN

SEQ ID No. 1043:
MNVITKCVFTASALLMLGLSSFVVSAQSPLLKEQIETIVTGKKATVGVAV

WGPDDLEPLLLNPFEKFPMQSVFKLHLAMLVLHQVDQGKLDLNQSVTVNR

AAVLQNTWSPMMKDHQGDEFTVAVQQLLQYSVSHSDNVACDLLFELVGGP

QALHAYIQSLGVKEAAVVANEAQMHADDQVQYQNWTSMKAAAQVLQKFEQ

KKQLSETSQALLWKWMVETTTGPQRLKGLLPAGTIVAHKTGTSGVRAGKT

AATNDAGVIMLPDGRPLLVAVFVKDSAESERTNEAIIAQVAQAAYQFELK

KLSAVSPD
```

-continued

```
SEQ ID No. 1044:
MNVIIKAVVTASTLLMVSFSSFETSAQSPLLKEQIESIVIGKKATVGVAV

WGPDDLEPLLINPFEKFPMQSVFKLHLAMLVLHQVDQGKLDLNQTVIVNR

AKVLQNTWAPIMKAYQGDEFSVPVQQLLQYSVSHSDNVACDLLFELVGGP

AALHDYIQSMGIKETAVVANEAQMHADDQVQYQNWTSMKGAAEILKKFEQ

KTQLSETSQALLWKWMVETTTGPERLKGLLPAGTVVAHKTGTSGIKAGKT

AATNDLGIILLPDGRPLLVAVFVKDSAESSRTNEAIIAQVAQTAYQFELK

KLSALSPN
``` said peptides being chosen, preferably, from the peptides of sequence SEQ ID No. 1045 to SEQ ID No. 1077 as defined hereafter:

| Peptide SEQ ID No. | Amino acid sequence | Position of the peptide in the PER protein(s) |
|---|---|---|
| SEQ ID No. 1045 | AAAQLLR | 190-196 for the proteins of SEQ No. 1041 |
| SEQ ID No. 1046 | AAAQVLQK | 190-197 for the proteins of SEQ No. 1043 |
| SEQ ID No. 1047 | AAVLQNTWSPMMK | 101-113 for the proteins of SEQ No. 1041, 1043 |
| SEQ ID No. 1048 | DSAESAR | 275-281 for the proteins of SEQ No. 1041 |
| SEQ ID No. 1049 | DSAESER | 275-281 for the proteins of SEQ No. 1043 |
| SEQ ID No. 1050 | DSAESSR | 275-281 for the proteins of SEQ No. 1038, 1039, 1040, 1042, 1044 |
| SEQ ID No. 1051 | EQIESIVIGK | 33-42 for the proteins of SEQ No. 1038, 1039, 1042, 1044 |
| SEQ ID No. 1052 | EQIETIVTGK | 33-42 for the proteins of SEQ No. 1041, 1043 |
| SEQ ID No. 1053 | ETEVVANEAQMHADDQVQYK | 164-183 for the proteins of SEQ No. 1041 |
| SEQ ID No. 1054 | FPMQSVFK | 67-74 for the proteins of SEQ No. 1038, 1039, 1040, 1041, 1042, 1043, 1044 |
| SEQ ID No. 1055 | GAAEILK | 190-196 for the proteins of SEQ No. 1038, 1039, 1040, 1042, 1044 |
| SEQ ID No. 1056 | GLLPAGTIVAHK | 228-239 for the proteins of SEQ No. 1043 |
| SEQ ID No. 1057 | GLLPAGTVVAHK | 228-239 for the proteins of SEQ No. 1038, 1039, 1040, 1041, 1042, 1044 |
| SEQ ID No. 1058 | GQIESIVIGK | 33-42 for the proteins of SEQ No. 1040 |

-continued

| Peptide SEQ ID No. | Amino acid sequence | Position of the peptide in the PER protein(s) |
|---|---|---|
| SEQ ID No. 1059 | LDLNK | 90-94 for the proteins of SEQ No. 1041 |
| SEQ ID No. 1060 | LDLNQSVTVNR | 90-100 for the proteins of SEQ No. 1043 |
| SEQ ID No. 1061 | LDLNQTVIVNR | 90-100 for the proteins of SEQ No. 1038, 1039, 1040, 1042, 1044 |
| SEQ ID No. 1062 | LHLAMLVLHQVDQGK | 75-89 for the proteins of SEQ No. 1038, 1039, 1040, 1042, 1043, 1044 |
| SEQ ID No. 1063 | MHLAMLVLHQVDQGK | 75-89 for the proteins of SEQ No. 1041 |
| SEQ ID No. 1064 | NWTSMK | 184-189 for the proteins of SEQ No. 1038, 1039, 1040, 1041, 1042, 1043, 1044 |
| SEQ ID No. 1065 | QLSETSQALLWK | 203-214 for the proteins of SEQ No. 1038, 1039, 1040, 1041, 1042, 1043, 1044 |
| SEQ ID No. 1066 | TAATNDAGVIMLPDGR | 250-265 for the proteins of SEQ No. 1043 |
| SEQ ID No. 1067 | TAATNDIGVIMLPDGR | 250-265 for the proteins of SEQ No. 1041 |
| SEQ ID No. 1068 | TAATNDLGIILLPDGR | 250-265 for the proteins of SEQ No. 1038, 1039, 1040, 1042, 1044 |
| SEQ ID No. 1069 | TGTSGIK | 240-246 for the proteins of SEQ No. 1038, 1039, 1040, 1044 |
| SEQ ID No. 1070 | TGTSGVR | 240-246 for the proteins of SEQ No. 1041, 1042, 1043 |
| SEQ ID No. 1071 | TNEAIIAQVAQAAYQFELK | 282-300 for the proteins of SEQ No. 1041, 1042, 1043 |
| SEQ ID No. 1072 | TNEAIIAQVAQTAYQFELK | 282-300 for the proteins of SEQ No. 1038, 1039, 1040, 1044 |
| SEQ ID No. 1073 | TQLSETSQALLWK | 202-214 for the proteins of SEQ No. 1038, 1039, 1040, 1042, 1044 |
| SEQ ID No. 1074 | TVAVNR | 95-100 for the proteins of SEQ No. 1041 |
| SEQ ID No. 1075 | VLQNTWAPIMK | 103-113 for the proteins of SEQ No. 1038, 1039, 1040, 1042, 1044 |
| SEQ ID No. 1076 | WMVETTTGPER | 215-225 for the proteins of SEQ No. 1038, 1039, 1040, 1042, 1044 |

| Peptide SEQ ID No. | Amino acid sequence | Position of the peptide in the PER protein(s) |
|---|---|---|
| SEQ ID No. 1077 | WMVETTTGPQR | 215-225 for the proteins of SEQ No. 1041, 1043 |

The detection of a mechanism of resistance to cephalosporins induced by the expression of the PER protein indicates an ESBL resistance. It is preferably detected with the aid of SEQ ID No. 1045 to SEQ ID No. 1065 and SEQ ID No. 1069 to SEQ ID No. 1077.

The detection of a mechanism of resistance to cephalosporins induced by the expression of the VEB protein is characterised by the detection of at least one peptide belonging to the VEB protein and to its different sequence variants SEQ ID No. 1078 to SEQ ID No. 1084.

SEQ ID No. 1078:
MKIVKRILLVLLSLFFTIVYSNAQTDNLTLKIENVLKAKNARIGVAIFNS
NEKDTLKINNDFHFPMQSVMKFPIALAVLSEIDKGNLSFEQKIEITPQDL
LPKTWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYY
LNK

SEQ ID No. 1079:
MKIVKRILLVLLSLFFTIVYSNAQADNLTLKIENVLKAKNARIGVAIFNS
NEKDTLKINNDFHFPMQSVMKFPIALAVLSEIDKGNLSFEQKIEITPQDL
LPKTWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYYLNK

SEQ ID No. 1080:
MKIVKRILLVLLSLFFTVVYSNAQTDNLTLKIENVLKAKNARIGVAIFNS
NEKDTFKINNDFHFPMQSVMKFPIALAVLSEIDKGNLSFEQKIEITPQDL
LPKTWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYYLNK

SEQ ID No. 1081:
MKIVKRILLVLLSLFFTIVYSNAQADNLTLKIENVLKAKNARIGVAIFNS
NEKDTLKINNDFHFPMQSVMKFPIALAVLSEIDKGNLSFEQKIEITPQDL
LPKMWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYYLNK

SEQ ID No. 1082:
MKIVKRILLVLLSLFFTVEYSNAQTDNLTLKIENVLKAKNARIGVAIFNS
NEKDTLKINNDFHFPMQSVMKFPIALAVLSEIDKGNLSFEQKIEITPQDL
LPKMWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYYLNK

SEQ ID No. 1083:
MKIVKRILLVLLSLFFTVVYSNAQADNLTLKIENVLKAKNARIGVAIFNS
NEKDTLKINNDFHFPMQSVMKFPIALAVLSEIDKGNLSFEQKIEITPQDL
LPKMWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGIAAA
TNDVGVITLPNGQLIFISVFVAESKETSEINEKIISDIAKITWNYYLNK

SEQ ID No. 1084:
MKIVKRILLVLLSLFFTVEYSNAQTDNLTLKIENVLKAKNARIGVAIFNS
NEKDTLKINNDFHFPMQSVMKFPIALAVLSEIDKGNLSFEQKIEITPQDL
LPKTWSPIKEEFPNGTTLTIEQILNYTVSESDNIGCDILLKLIGGTDSVQ
KFLNANHFTDISIKANEEQMHKDWNTQYQNWATPTAMNKLLIDTYNNKNQ
LLSKKSYDFIWKIMRETTTGSNRLKGQLPKNTIVAHKTGTSGINNGITAA
TNDVGVITLPNGQLIFISVFVAESKETSEINEKIISDIAKITWNYYLNK said peptides being chosen, preferably, from the peptides of sequence SEQ ID No. 1085 to SEQ ID No. 1104 as defined hereafter:

| Peptide SEQ ID No. | Amino acid sequence | Position of the peptide in the VEB protein(s) |
|---|---|---|
| SEQ ID No. 1085 | ANEEQMHK | 165-172 for the proteins of SEQ No. 1078, 1079, 1080, 1081, 1082, 1083, 1084 |
| SEQ ID No. 1086 | DWNTQYQNWATPTAMNK | 173-189 for the proteins of SEQ No. 1078, 1079, 1080, 1081, 1082, 1083, 1084 |

-continued

| Peptide SEQ ID No. | Amino acid sequence | Position of the peptide in the VEB protein(s) |
|---|---|---|
| SEQ ID No. 1087 | ETSEINEK | 276-283 for the proteins of SEQ No. 1078, 1079, 1080, 1081, 1082, 1083, 1084 |
| SEQ ID No. 1088 | ETTTGSNR | 216-223 for the proteins of SEQ No. 1078, 1079, 1080, 1081, 1082, 1083, 1084 |
| SEQ ID No. 1089 | FLNANHFTDISIK | 152-164 for the proteins of SEQ No. 1078, 1079, 1080, 1081, 1082, 1083, 1084 |
| SEQ ID No. 1090 | FPIALAVLSEIDK | 72-84 for the proteins of SEQ No. 1078, 1079, 1080, 1081, 1082, 1083, 1084 |
| SEQ ID No. 1091 | GNLSFEQK | 85-92 for the proteins of SEQ No. 1078, 1079, 1080, 1081, 1082, 1083, 1084 |
| SEQ ID No. 1092 | GQLPK | 226-230 for the proteins of SEQ No. 1078, 1079, 1080, 1081, 1082, 1083, 1084 |
| SEQ ID No. 1093 | IEITPQDLLPK | 93-103 for the proteins of SEQ No. 1078, 1079, 1080, 1081, 1082, 1083, 1084 |
| SEQ ID No. 1094 | IENVLK | 32-37 for the proteins of SEQ No. 1078, 1079, 1080, 1081, 1082, 1083, 1084 |
| SEQ ID No. 1095 | IGVAIFNSNEK | 43-53 for the proteins of SEQ No. 1078, 1079, 1080, 1081, 1082, 1083, 1084 |
| SEQ ID No. 1096 | IISDIAK | 284-290 for the proteins of SEQ No. 1078, 1079, 1080, 1081, 1082, 1083, 1084 |
| SEQ ID No. 1097 | INNDFHFPMQSVMK | 58-71 for the proteins of SEQ No. 1078, 1079, 1080, 1081, 1082, 1083, 1084 |
| SEQ ID No. 1098 | LIGGTDSVQK | 142-151 for the proteins of SEQ No. 1078, 1079, 1080, 1081, 1082, 1083, 1084 |
| SEQ ID No. 1099 | LLIDTYNNK | 190-198 for the proteins of SEQ No. 1078, 1079, 1080, 1081, 1082, 1083, 1084 |
| SEQ ID No. 1100 | MWSPIK | 104-109 for the proteins of SEQ No. 1081, 1082, 1083 |
| SEQ ID No. 1101 | NQLLSK | 199-204 for the proteins of SEQ No. 1078, 1079, 1080, 1081, 1082, 1083, 1084 |
| SEQ ID No. 1102 | NTIVAHK | 231-237 for the proteins of SEQ No. 1078, 1079, 1080, 1081, 1082, 1083, 1084 |
| SEQ ID No. 1103 | SYDFIWK | 206-212 for the proteins of SEQ No. 1078, 1079, 1080, 1081, 1082, 1083, 1084 |
| SEQ ID No. 1104 | TWSPIK | 104-109 for the proteins of SEQ No. 1078, 1079, 1080, 1084 |

The detection of a mechanism of resistance to cephalosporins induced by the expression of the VEB protein indicates an ESBL resistance.

The detection of a mechanism of resistance to cephalosporins or to carbapenems induced by the expression of the OXA protein is characterised by the detection of at least one peptide belonging to the OXA protein and to its different sequence variants SEQ ID No. 1105 to SEQ ID No. 1266:

SEQ. ID. No. 1105:
MSRLLLSGLLATGLLCAVPASAASGCFLYADGNGQTLSSEGDCSSQLPPASTFKIPL

ALMGYDSGFLVNEEHPALPYKPSYDGWLPAWRETTTPRRWETYSVVWFSQQITE

WLGMERFQQYVDRFDYGNRDLSGNPGKHDGLTQAWLSSSLAISPEEQARFLGKM

VSGKLPVSAQTLQYTANILKVSEVEGWQIHGKTGMGYPKKLDGSLNRDQQIGWFV

GWASKPGKQLIFVHTVVQKPGKQFASIKAKEEVLAALPAQLKKL

SEQ ID No. 1106:
IACLSSTALAGSITENTSWNKEFSAEAVNGVFVLCKSSSKSCATNDLARASKEYLPA

STFKIPNAIIGLETGVIKNEHQVFKWDGKPRAMKQWERDLTLRGAIQVSAVPVFQQI

AREVGEVRMQKYLKKFSYGNQNISGGIDKFWLEDQLRISAVNQVEFLESLYLNKLSA

SKENQLIVKEALVTEAAPEYLVHSKTGFSGVGTESNPGVAWWVGWVEKETEVYFF

AFNMDIDNESKLPLRKSIPTKIMESEGIIGG

SEQ ID No. 1107:
MKKILLLHMLVFVSATLPISSVASDEVETLKCTIIADAITGNTLYETGECARRVSPCSS

FKLPLAIMGFDSGILQSPKSPTWELKPEYNPSPRDRTYKQVYPALWQSDSVVWFSQ

QLTSRLGVDRFTEYVKKFEYGNQDVSGDSGKHNGLTQSWLMSSLTISPKEQIQFLL

RFVAHKLPVSEAAYDMAYATIPQYQAAEGWAVHGKSGSGWLRDNNGKINESRPQ

GWFVGWAEKNGRQVVFARLEIGKEKSDIPGGSKAREDILVELPVLMGNK

SEQ ID No. 1108:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNAGPSTSNGDYWIEGSLAISAQE

QIAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1109:
MQRSLSMSGKRHFIFAVSFVISTVCLTFSPANAAQKLSCTLVIDEASGDLLHREGSC

DKAFAPMSTFKLPLAIMGYDADILLDATTPRWDYKPEFNGYKSQQKPTDPTIWLKDS

IVWYSQELTRRLGESRFSDYVQRFDYGNKDVSGDPGKHNGLTHAWLASSLKISPEE

QVRFLRRFLRGELPVSEDALEMTKAVVPHFEAGDWDVQGKTGTGSLSDAKGGKAP

IGWFIGWATRDDRRVVFARLTVGARKGEQPAGPAARDEFLNTLPALSENF

SEQ ID No. 1110:
MKTFAAYVIIACLSSTALAGSITENTSWNKEFSAEAVNGVFVLCKSSSKSCATNDLAR

ASKEYLPASTFKIPNAIIGLETGVIKNEHQVFKWDGKPRAMKQWERDLTLRGAIQVS

AVPVFQQIAREVGEVRMQKYLKKFSYGNQNISGGIDKFWLEGQLRISAVNQVEFLE

SLYLNKLSASKENQLIVKEALVTEAAPEYLVHSKTGFSGVGTESNPGVAWWVGWVE

KETEVYFFAFNMDIDNESKLPLRKSIPTKIMESEGIIGG

SEQ ID No. 1111:
IACLSSTALAGSITENTSWNKEFSAEAVNGVFVLCKSSSKSCATNDLARASKEYLPA

STFKIPNAIIGLETGVIKNEHQVFKWDGKPRAMKQWERDLTLRGAIQVSAVPVFQQIT

REVGEVRMQKYLKKFSYGNQNISGGIDKFWLEDQLRISAVNQVEFLESLYLNKLSAS

-continued

KENQLIVKEALVTEAAPEYLVHSKTGFSGVGTESNPGVAWWVGWVEKETEVYFFA

FNMDIDNESKLPLRKSIPTKIMESEGIIGG

SEQ ID No. 1112:
IACLSSTALAGSITENTSWNKEFSAEAVNGVFVLCKSSSKSCATNDLARASKEYLPA

STFKIPSAIIGLETGVIKNEHQVFKWDGKPRAMKQWERDLTLRGAIQVSAVPVFQQIA

REVGEVRMQKYLKKFSYGNQNISGGIDKFWLEGQLRISAVNQVEFLESLYLNKLSAS

KENQLIVKEALVTEAAPEYLVHSKTGFSGVGTESNPGVAWWVGWVEKETEVYFFA

FNMDIDNESKLPLRKSIPTKIMESEGIIGG

SEQ ID No. 1113:
MIIRFLALLFSAVVLVSLGHAQEKTHESSNWGKYFSDFNAKGTIVVVDERTNGNSTS

VYNESRAQQRYSPASTFKIPHTLFALDAGAVRDEFHVFRWDGAKRSFAGHNQDQN

LRSAMRNSTVWVYQLFAKEIGENKARSYLEKLNYGNADPSTKSGDYWIDGNLAISA

NEQISILKKLYRNELPFRVEHQRLVKDLMIVEAKRDWILRAKTGWDGQMGWWVGW

VEWPTGPVFFALNIDTPNRMEDLHKREAIARAILQSVNALPPN

SEQ ID No. 1114:
MAIRIFAILFSTFVFGTFAHAQEGMRERSDWRKFFSEFQAKGTIVVADERQTDRVILV

FDQVRSEKRYSPASTFKIPHTLFALDAGAARDEFQVFRWDGIKRSFAAHNQDQDLR

SAMRNSTVWIYELFAKEIGEDKARRYLKQIDYGNADPSTSNGDYWIDGNLAIAAQEQ

IAFLRKLYHNELPFRVEHQRLVKDLMIVEAGRNWILRAKTGWEGRIGWWVGWVEW

PTGPVFFALNIDTPNRMDDLFKREAIVRAILRSIEALPPNPAVNSDAAR

SEQ ID No. 1115:
MKTFAAYVITACLSSTALASSITENTSWNKEFSAEAVNGVFVLCKSSSKSCATNNLA

RASKEYLPASTFKIPSAIIGLETGVIKNEHQVFKWDGKPRAMKQWERDLSLRGAIQV

SAVPVFQQIAREVGEVRMQKYLKKFSYGNQNISGGIDKFWLEGQLRISAVNQVEFL

ESLFLNKLSASKENQLIVKEALVTEAAPEYLVHSKTGFSGVGTESNPGVAWWVGWV

EKGTEVYFFAFNMDIDNENKLPLRKSIPTKIMASEGIIGG

SEQ ID No. 1116:
MKTFAAYVITACLSSTALASSITENTSWNKEFSAEAVNGVFVLCKSSSKSCATNNLA

RASKEYLPASTFKIPNAIIGLETGVIKNEHQVFKWDGKPRAMKQWERDLSLRGAIQV

SAVPVFQQIAREVGEVRMQKYLKKFSYGNQNISGGIDKFWLEDQLRISAVNQVEFLE

SLFLNKLSASKENQLIVKEALVTEAAPEYLVHSKTGFSGVGTESNPGVAWWVGWVE

KGTEVYFFAFNMDIDNENKLPLRKSIPTKIMASEGIIGG

SEQ ID No. 1117:
MKTFAAYVITACLSSTALASSITENTSWNKEFSAEAVNGVFVLCKSSSKSCATNNLA

RASKEYLPASTFKIPNAIIGLETGVIKNEHQVFKWDGKPRAMKQWERDLSLRGAIQV

SAVPVFQQIAREVGEVRMQKYLKKFSYGNQNISGGIDKFGLEGQLRISAVNQVEFLE

SLFLNKLSASKENQLIVKEALVTEAAPEYLVHSKTGFSGVGTESNPGVAWWVGWVE

KGTEVYFFAFNMDIDNENKLPLRKSIPTKIMASEGIIGG

SEQ ID No. 1118:
MKNTIHINFAIFLIIANIIYSSASASTDISTVASPLFEGTEGCFLLYDASTNAEIAQFNKA

KCATQMAPDSTFKIALSLMAFDAEIIDQKTIFKWDKTPKGMEIWNSNHTPKTWMQFS

VVWVSQEITQKIGLNKIKNYLKDFDYGNQDFSGDKERNNGLTEAWLESSLKISPEEQ

IQFLRKIINHNLPVKNSAIENTIENMYLQDLDNSTKLYGKTGAGFTANRTLQNGWFEG

FIISKSGHKYVFVSALTGNLGSNLTSSIKAKKNAITILNTLNL

-continued

SEQ ID No. 1119:
ANIIYSSASASTDISTVASPLFEGTEGCFLLYDVSTNAEIAQFNKAKCATQMAPDSTF

KIALSLMAFDAEIIDQKTIFKWDKTPKGMEIWNSNHTPKTWMQFSVVWVSQEITQKI

GLNKIKNYLKDFDYGNQDFSGDKERNNGLTEAWLESSLKISPEEQIQFLRKIINHNLP

VKNSAIENTIENMYLQDLENSTKLYGKTGAGFTANRTLQNGWFEGFIISKSGHKYVF

VSALTGNLGSNLTSSIKAKKNAITIL

SEQ ID No. 1120:
IFSLATFAHAQEGTLERSDWRKFFSEFQAKGTIVVADERQADRAMLVFDPVRSKKR

YSPASTFKIPHTLFALDAGAVRDEFQIFRWDGVNRGFAGHNQDQDLRSAMRNSTV

WVYELFAKEIGDDKARRYLKKIDYGNAYPSTSNGDYWIEGSLAISAQEQIAFLRKLYR

NELPFRVEHQRLVKDLMIVEAGRNWILRAKTGWEGRMGWWVGWVEWPTGSVFFA

LNIDTPNRMDDLFKREAIVRAIL

SEQ ID No. 1121:
MIIRFLALLFSAVVLVSLGHAQDKTHESSNWGKYFSDFNAKGTIVVVDERTNGNSTS

VYNESRAQQRYSPASTFKIPHTLFALDAGAVRDEFHVFRWDGAKRSFAGHNQDQN

LRSAMRNSTVWVYQLFAKEIGENKARSYLEKLNYGNADPSTKSGDYWIDGNLAISA

NEQISILKKLYRNELPFRVEHQRLVKDLMIVEAKRDWILRAKTGWDGQMGWVGW

VEWPTGPVFFALNIDTPNRMEDLHKREAIARAILQSVNALPPN

SEQ ID No. 1122:
MKKFILPIFSISILVSLSACSSIKTKSEDNFHISSQQHEKAIKSYFDEAQTQGVIIIKEGK

NLSTYGNALARANKEYVPASTFKMLNALIGLENHKATTNEIFKWDGKKRTYPMWEK

DMTLGEAMALSAVPVYQELARRTGLELMQKEVKRVNFGNTNIGTQVDNFWLVGPL

KITPVQEVNFADDLAHNRLPFKLETQEEVEKMLLIKEVNGSKIYAKSGWGMGVTPQV

GWLTGWVEQANGKKIPFSLNLEMKEGMSGSIRNEITYKLLENLGII

SEQ ID No. 1123:
MKKFILPIFSISILVSLSACSSIKTKSEDNFHISSQQHEKAIKSYFDEAQTQGVIIIKEGK

NLSTYGNALARANKEYVPASTFKMLNALIGLENHKATTNEIFKWDGKKRTYPMWEK

DMTLGEAMALSAVPVYQELARRTGLELMQKEVKRVNFGNTNIGTQVDNFWLVGPL

KITPVQEVNFADDLAHNRLPFKLETQEEVKKMLLIKEVNGSKIYAKSGWGMGVTPQV

GWLTGWVEQANGKKIPFSLNLEMKEGMTGSIRNEITYKSLENLGII

SEQ ID No. 1124:
MNKYFTCYVVASLFLSGCTVQHNLINETPSQIVQGHNQVIHQYFDEKNTSGVLVIQT

DKKINLYGNALSRANTEYVPASTFKMLNALIGLENQKADINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALKMEMRSEMPASIRNELLMKSLKQLNII

SEQ ID No. 1125:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNADPSTSNGDYCIEGSLAISAQEQ

IAFLRKLYRNELPFRVEHQRLVKDLMIVEAGRNWILRAKTGWEGRMGWWVGWVE

WPTGSVFFALNIDTPNRMDDLFKREAIVRAIL

SEQ ID No. 1126:
MKTFAAYVITACLSSTALASSITENTSWNKEFSAEAVNGVFVLCKSSSKSCATNNLA

RASKEYLPASTFKIPNAIIGLETGVIKNEHQVFKWDGKPRAMKQWERDLSLRGAIQV

```
SAVPVFQQIAREVGEVRMQKYLKKFSYGNQNISGGIDKFWLEGQLRISAVNQVEFL

ESLFLNKLSASKENQLIVKEALVTEAAPEYLVHSKTGFSGVGTESNPGVAWWVGWV

EKGTEVYFFAFNMDIDNENKLPLRKSIPTKIMASEGIIGG

SEQ ID No. 1127:
MAIRFLTILLSTFFLTSFVHAQEHVLERSDWKKFFSDLRAEGAIVISDERQAEHALLVF

GQERAAKRYSPASTFKLPHTLFALDADAVRDEFQVFRWDGVKRSFAGHNQDQDLR

SAMRNSAVWVYELFAKEIGKDKARHYLKQIDYGNADPSTIKGDYWIDGNLEISAHEQ

ISFLRKLYRNQLPFQVEHQRLVKDLMITEAGRNWILRAKTGWEGRFGWWVGWVE

WPTGPVFFALNIDTPNRTDDLFKREAIARAILRSIDALPPN

SEQ ID No. 1128:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNADPSTSNGDYWIEGSIAISAQEQ

IAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1129:
MKKFILPIFSISILVSLSACSSIKTKSEDNFHISSQQHEKAIKSYFDEAQTQGVIIIKEGK

NLSTYGNALARANKEYVPASTFKMLNALIGLENHKATTNEIFKWDGKKRTYPMWEK

DMTLGEAMALSAVPVYQELARRTGLELMQKEVKRVNFGNTNIGTQVDNFWLVGPL

KITPVQEVNFADDLAHNRLPFKLETQEEVKKMLLIKEVNGSKIYAKSGWGMGVTPQV

GWLTGWVEQANGKKIPFSLNLEMKEGMSGSIRNEITYKSLENLGII

SEQ ID No. 1130:
MAIRFLTILLSTFFLTSFVHAQEHVLERSDWKKFFSDLRAEGAIVISDERQAEHALLVF

GQERAAKRYSPASTFKLPHTLFALDADAVRDEFQVFRWDGVKRSFAGHNQDQDLR

SAMRNSAVWVYELFAKEIGEDKARRYLKQIDYGNADPSTIKGDYWIDGNLEISAHEQ

ISFLRKLYRNQLPFQVEHQRLVKDLMITEAGRNWILRAKTGWEGRFGWWVGWVE

WPTGPVFFALNIDTPNRTDDLFKREAIARAILRSIDALPPN

SEQ ID No. 1131:
MAIRFFTILLSTFFLTSFVYAQEHVVIRSDWKKFFSDLQAEGAIVIADERQAKHTLSVF

DQERAAKRYSPASTFKIPHTLFALDADAVRDEFQVFRWDGVNRSFAGHNQDQDLR

SAMRNSTVWVYELFAKDIGEDKARRYLKQIDYGNVDPSTIKGDYWIDGNLKISAHEQ

ILFLRKLYRNQLPFKVEHQRLVKDLMITEAGRSWILRAKTGWEGRFGWWVGWIEW

PTGPVFFALNIDTPNRTDDLFKREAIARAILRSIDALPPN

SEQ ID No. 1132:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVERIGFGNAEIGQQVDNFWLVGPL

KVTPIQEVEFVSQLAHTQLPFSEKVQANVKNMLLLEESNGYKIFGKTGWAAMDIKPQ

VGWLTGWVEQPDGKIVAFALNMEMRSEMPASIRNELLMKSLKQLNII

SEQ ID No. 1133:
MAIQIFAILFSTFVLATFAHAQDGTLERSDWGKFFSDFQAKGTIVVADERQADHAILV

FDQARSMKRYSPASTFKIPHTLFALDAGAVRDEFQIFRWDGVKRSFAGHNKDQDLR

SAMRNSTVWVYELFAKEIGDGKARRYLKQIGYGNADPSTHGDYWIEGSLAISAQE
```

QIAFLRKLYQNDLPFRVEHQRLVKDLMIVEAGRNWILRAKTGWEGSMGWWVGWV

EWPTGPVFFALNIDTPNRMDDLFKREAIARAILLSIEALPPNPAVHSDAAR

SEQ ID No. 1134:
MKNTIHINFAIFLIIANIIYSSASASTDISTVASQLFEGTEGCFLLYDASTNAEIAQFNKA

KCAAQMAPDSTFKIALSLMAFDAEIIDQKTIFKWDKIPKGMEIWNSNHTPKTWMQFS

VVWVSQEITQKIGLNKIKNYLKDFDYGNQDFSGDKERNNGLTEAWLESSLKISPEEQ

IQFLRKIINHNLPVRNSAIENTIDNMYLQDLENSTKLYGKTGAGFTANRTLQNGWFEG

FIISKSGHKYVFVSALTGSLGSNLTSSIKAKKNAITILNTLNL

SEQ ID No. 1135:
MLLFMFSIISFGNENQFMKEIFERKGLNGTFVVYDLKNDKIDYYNLDRANERFYPASS

FKIFNTLIGLENGIVKNVDEMFYYYDGSKVFLDSWAKDSNLRYAIKVSQVPAYKKLAR

ELGKERMQEGLNKLNYGNKEIGSEIDKFWLEGPLKISAMEQVKLLNLLSQSKLPFKL

ENQEQVKDITILEKKDDFILHGKTGWATDNIVVPIGWFVGWIETSDNIYSFAINLDISD

SKFLPKREEIVREYFKNINVIK

SEQ ID No. 1136:
MRVLALSAVFLVASIIGMPAVAKEWQENKSWNAHFTEHKSQGVVVLWNENKQQGF

TNNLKRANQAFLPASTFKIPNSLIALDLGVVKDEHQVFKWDGQTRDIATWNRDHNLI

TAMKYSVVPVYQEFARQIGEARMSKMLHAFDYGNEDISGNVDSFWLDGGIRISATE

QISFLRKLYHNKLHVSERSQRIVKQAMLTEANGDYIIRAKTGYSTRIEPKIGWWVGW

VELDDNVWFFAMNMDMPTSDGLGLRQAITKEVLKQEKIIP

SEQ ID No. 1137:
MLSRYSKTLAFAVVACTLAISTATAHAELVVRNDLKRVFDDAGVSGTFVLMDITADR

TYVVDPARAARSIHPASTFKIPNSLIAFDTGAVRDDQEVLPYGGKPQPYEQWEHDM

ALPEAIRLSAVPIYQEVARRVGFERMQAYVDAFDYGNRQLGSAIDQFWLRGPLEISA

FEEARFTSRMALKQLPVKPRTWDMVQRMLLIEQQGDAALYAKTGVATEYQPEIGW

WAGWVERAGHVYAFALNIDMPREGDMAKRIPLGKQLMRALEVWPAP

SEQ ID No. 1138:
MRPLLFSALLLLSGHTQASEWNDSQAVDKLFGAAGVKGTFVLYDVQRQRYVGHDR

ERAETRFVPASTYKVANSLIGLSTGAVRSADEVLPYGGKPQRFKAWEHDMSLRDAI

KASNVPVYQELARRIGLERMRANVSRLGYGNAEIGQVVDNFWLVGPLKISAMEQTR

FLLRLAQGELPFPAPVQSTVRAMTLLESGPGWELHGKTGWCFDCTPELGWWVGW

VKRNERLYGFALNIDMPGGEADIGKRVELGKASLKALGILP

SEQ ID No. 1139:
MNKGLHRKRLSKRLLLPMLLCLLAQQTQAVAAEQTKVSDVCSEVTAEGWQEVRRW

DKLFESAGVKGSLLLWDQKRSLGLSNNLSRAAEGFIPASTFKLPSSLIALETGAVRD

ETSRFSWDGKVREIAVWNRDQSFRTAMKYSVVPVYQQLAREIGPKVMAAMVRQLE

YGNQDIGGQADSFWLDGQLRITAFQQVDFLRQLHDNKLPVSERSQRIVKQMMLTE

ASTDYIIRAKTGYGVRRTPAIGWWVGWLELDDNTVYFAVNLDLASASQLPLRQQLV

KQVLKQEQLLP

SEQ ID No. 1140:
MNTIISRRWRAGLWRRLVGAVVLPATLAATPAAYAADVPKAALGRITERADWGKLF

AAEGVKGTIVVLDARTQTYQAYDAARAEKRMSPASTYKIFNSLLALDSGALDNERAII

PWDGKPRRIKNWNAAMDLRTAFRVSCLPCYQVVSHKIGRRYAQAKLNEVGYGNRT

IGGAPDAYWVDDSLQISAREQVDFVQRLARGTLPFSARSQDIVRQMSIVEATPDYVL

-continued

HGKTGWFVDKKPDIGWWVGWIERDGNITSVAINIDMLSEADAPKRARIVKAVLKDLK

LI

SEQ ID No. 1141:
MKTFAAYVITACLSSTALASSITENTFWNKEFSAEAVNGVFVLCKSSSKSCATNNLA

RASKEYLPASTFKIPNAIIGLETGVIKNEHQIFKWDGKPRAMKQWERDLSLRGAIQVS

AVPVFQQIAREVGEVRMQKYLKKFSYGNQNISGGIDKFWLEGQLRISAVNQVEFLE

SLFLNKLSASKENQLIVKEALVTEAAPEYLVHSKTGFSGVGTESNPGVAWWVGWVE

KGAEVYFFAFNMDIDNENKLPLRKSIPTKIMASEGIIGG

SEQ ID No. 1142:
MRVLALSAVLVVASIVGMPAMANEWQEKPSWNTHFSEHKAQGVIVLWNENKQQGF

TNNLKRANQAFLPASTFKIPNSLIALDLGVVKDEHQVFKWDGQTRDIAAWNRDHDLI

TAMKYSVVPVYQEFARQIGQARMSKMLHAFDYGNEDISGNLDSFWLDGGIRISATE

QVAFLRKLYHNKLHVSERSQRIVKQAMLTEANSDYIIRAKTGYSTRIEPQIGWWVGW

VELDDNVWFFAMNMDMPTADGLGLRQAITKEVLKQEKIIP

SEQ ID No. 1143:
MKKITLFLLFLNLVFGQDKILNNWFKEYNTSGTFVFYDGKTWASNDFSRAMETFSPA

STFKIFNALIALDSGVIKTKKEIFYHYRGEKVFLSSWAQDMNLSSAIKYSNVLAFKEVA

RRIGIKTMQEYLNKLHYGNAKISKIDTFWLDNSLKISAKEQAILLFRLSQNSLPFSQEA

MNSVKEMIYLKNMENLELFGKTGFNDGQKIAWIVGFVYLKDENKYKAFALNLDIDKF

EDLYKREKILEKYLDELVKKVKNDG

SEQ ID No. 1144:
MSKKNFILIFIFVILISCKNTEKISNETTLIDNIFTNSNAEGTLVIYNLNDDKYIIHNKERAE

QRFYPASTFKIYNSLIGLNEKAVKDVDEVFYKLMAKSFLESWAKDSNLRYAIKNSQV

PAYKELARRIGIKKMKENIEKLDFGNKSIGDSVDTFWLEGPLEISAMEQVKLLTKLAQ

NELQYPIEIQKAISDITITRANLHITLHGKTGLADSKNMTTEPIGWFVGWLEENDNIYV

FALNIDNINSDDLAKRINIVKESLKALNLLK

SEQ ID No. 1145:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALKMEMRSEMPASIRNELLMKSLKQLNII

SEQ ID No. 1146:
MNIQALLLITSAIFISACSPYIVTANPNYSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRIGYGNADIGTQVDNFWLVGPLKI

TPQQEAQFAYKLANKTLPFSQKVQDEVQSMLFIEEKNGNKIYAKSGWGWDVNPQV

GWVVQPQGNIVAFSLNLEMKKGISSSVRKEITYRGLEQLGIL

SEQ ID No. 1147:
MNIKALLLITSAIFISACSPYIVTANPNHSASKSDEKGEKIKNLFNEAHTTGVLVIQQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1148:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1149:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1150:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

ITPQQEAQFAYKLANKTLPFSQEVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1151:
MNIKALLLITSAIFISACSPYIVTANPNHSASKSDDKAEKIKNLFNEAHTTGVLVIHQGQ

TQQSYGNDLARASTEYVPASTFKMLNALIGLEHHKATTTEVFKWDGEKRLFPEWEK

NMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1152:
MNIKALLLITSAIFISACSPYIVTANPNHSASKSDKKAEKIKNLFNEAHTTGVLVIQQGQ

TQQSYGNDLARASTEYVPASTFKMLNALIGLEHHKATTTEVFKWNGQKRLFPEWEK

DMTLGDAMKASAIPVYQDLARRIGLELMSNEVKRVGYGNADIGTQVDNFWLVGPLK

ITPQQEAQFAYKLANKTLPFSQKVQHEVQSMLFIEEKNGNKIYAKSGWGWDVDPQV

GWLTGWVVQPQGNIVAFSLNLEMKKGIPSSVRKEITYKSLEQLGIL

SEQ ID No. 1153:
MNIKALLLITSAIFISACSPYIVTANPNHSASKSDEKAEKIKNLFNEAHTTGVLVIQQGQ

TQQSYGNDLARASTEYVPASTFKMLNALIGLEHHKTTTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1154:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTAVFKWDGQKRLFPEWEK

NMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGTPSSVRKEITYKSLEQLGIL

SEQ ID No. 1155:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

```
SEQ ID No. 1156:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEKLGIL

SEQ ID No. 1157:
MNIKTLLLITSTIFISACSPYIVTANPNHSTSKSDEKAEKIKNLFNEAHTTGVLVIQQGQ

TQQSYGNDLARASIEYVPASTFKMLNALIGLEHHKATTTEIFKWDGQKRLFPEWEKD

MTLGDAMKASAIPVYQDLARRIGLELMSKEVKRVGYGNADIGTQVDNFWLVGPLKIT

PQQEAQFAYKLANKTLPFSLKVQDEVQSMLFIEEKNGNKIYAKSGWGWDVDPQVG

WLTGWVVQPQGNIVAFSLNLEMKKGIPSSVRKEITYKSLEQLGIL

SEQ ID No. 1158:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAISVYQDLARRIGLELMSKEVKRVGYGNADIGTQVDNFWLAGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1159:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASALPVYQDLARRIGLELMSKEVKRVGYGNADIGTQVDNFWLVGPL

KITPQQEAQFAYKLANKTLPFSQKVQDEVQSMLFIEEKNGNKIYAKSGWGWDVNPQ

VGWLTGWVVQPQGNIVAFSLNLEMKKGIPSSVRKEITYKSLEQLGIL

SEQ ID No. 1160:
MNIKALLLITSAIFISACSPYIVTANPNHSASKSDDKAEKIKNLFNEAHTTGVLVIHQGQ

TQQSYGNDLARASTEYVPASTFKMLNALIGLEHHKATTTEVFKWDGEKRLFPEWEK

NMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGSVVQPQGNIVAFSLNLEMKKGIPSSVRKEITYKSLEQLGIL

SEQ ID No. 1161:
MNIKTLLLITSTIFISACSPYIVTANPNHSTSKSDEKAEKIKNLFNEAHTTGVLVIQQGQ

TQQSYGNDLARASIEYVPASTFKMLNALIGLEHHKATTTEIFKWDGQKRLFPEWEKD

MTLGDAMKASAIPVYQDLARRIGLELMSKEVKRVGYGNADIGTQVDNFWLVGPLKIT

PQQEAQFAYKLANKTLPFSLKAQDEVQSMLFIEEKNGNKIYAKSGWGWDVDPQVG

WLTGWVVQPQGNIVAFSLNLEMKKGIPSSVRKEITYKSLEQLGIL

SEQ ID No. 1162:
MNIKALLLITSAIFISACSPYIVTANPNHSASKSDKKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK
```

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1163:
MNIKTLLLITSAIFISACSHYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

ITPQQEAQFTYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1164:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1165:
MNIKALLLITSTIFISACSPYIVTANPNHSASKSDEKAEKIKNLFNEAHTTGVLVIQQGQ

TQQSYGNDLARASTEYVPASTFKMLNALISLEHHKATTTEVFKWDGQKRLFPEWEK

DMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1166:
MNIQALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPHGNIVAFSLNLEMKKGIPSSVRKEITYKSLEQLGIL

SEQ ID No. 1167:
MNIKALFLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1168:
MKLLKILSLVCLSISIGACAEHSMSRAKTSTIPQVNNSIIDQNVQALFNEISADAVFVTY

DGQNIKKYGTHLDRAKTAYIPASTFKIANALIGLENHKATSTEIFKWDGKPRFFKAWD

KDFTLGEAMQASTVPVYQELARRIGPSLMQSELQRIGYGNMQMGTEVDQFWLKGP

LTITPIQEVKFVYDLAQGQLPFKPEVQQQVKEMLYVERRGENRLYAKSGWGMAVD

PQVGWYVGFVEKADGQVVAFALNMQMKAGDDIALRKQLSLDVLDKLGVFHYL

SEQ ID No. 1169:
MNIKALLLITSTIFISACSPYIVTANPNHSTSKSDEKAEKIKNLFNEAHTTGVLVIQQGQ

TQQSYGNDLARASTEYVPASTFKMLNALIGLEHHKATTTEIFKWDGQKRLFPEWEK

DMTLGDAMKASAIPVYQDLARRIGLELMSKEVKRVGYGNADIGTQVDNFWLVGPLK

ITPQQEAQFAYKLANKTLPFSLKVQDEVQSMLFIEEKNGNKIYAKSGWGWDVDPQV

GWLTGWVVQPQGNIVAFSLNLEMKKGIPSSVRKEITYKSLEQLGIL

-continued

SEQ ID No. 1170:
MNIKTLLLITSAIFISACSPYIVTANPNHSASKSDEKAEKIKNLFNEVHTTGVLVIRQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEMNGNKIYAKSGWGWDVDPQV

GWLTGWVVQPQGNIVAFSLNLEMKKGIPSSVRKEITYKSLEQLGIL

SEQ ID No. 1171:
MKLLKILSLVCLSISIGACAEHSMSRAKTSTIPQVNNSIIDQNVQALFNEISGDAVFVTY

DGQNIKKYGTHLDRAKTAYIPASTFKIANALIGLENHKATSTEIFKWDGKPRFFKAWD

KDFTLGEAMQASTVPVYQELARRIGPSLMQSELQRIGYGNMQIGTEVDQFWLKGPL

TITPIQEVKFVYDLAQGQLPFKPEVQQQVKEMLYVERRGENRLYAKSGWGMAVDP

QVGWYVGFVEKADGQVVAFALNMQMKAGDDIALRKQLSLDVLDKLGVFHYL

SEQ ID No. 1172:
MKKFILPIFSISILVSLSACSSIKTKSEDNFHISSQQHEKAIKSYFDEAQTQGVIIIKEGK

NLSTYGNALARANKEYVPASTFKMLNALIGLENHKATTNEIFKWDGKKRTYPMWEK

DMTLGEAMALSAVPVYQELARRTGLELMQKEVKRVNFGNTNIGTQVDNFWLVGPL

KITPVQEVNFADDLAHNRLPFKLETQEEVKKMLLIKEVNGSKIYAKSGWGMDVTPQV

GWLTGWVEQANGKKIPFSLNLEMKEGMSGSIRNEITYKSLENLGII

SEQ ID No. 1173:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNADPSTSNGDYWIESSLAISAQE

QIAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1174:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGKKRLFPEWEK

NMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1175:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAILVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1176:
MNIKALLLITSAIFISACSPYIVTANPNHSASKSDKKAEKIKNLFNEAHTTGVLVIQQGQ

TQQSYGNDLARASTEYVPASTFKMLNALIGLEHHKATTTEVFKWNGQKRLFPEWEK

DMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1177:
MNIKALLLITSAIFISACSPYIVTANPNHSASKSDDKAEKIKNLFNEAHTTGVLVIHQGQ

TQQSYGNDLARASTEYVPASTFKMLNALIGLEHHKATTTEVFKWDGEKRLFPEWEK

-continued

NMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1178:
MNIKALLLITSAIFISACSPYIVTTNPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNTDIGTQVDNFWVVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1179:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIQVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1180:
MNIKALLLITSAIFISACSPYIVTANPNHSASKSDDKAEKIKNLFNEAHTTGVLVIHQGQ

TQQSYGNDLARASTEYVPASTFKMLNALIGLEHHKATTTEVFKWDGEKRLFPEWEK

NMTLGDAMKASALPVYQDLARRIGLELMSKEVKRVGYGNADIGTQVDNFWLVGPL

KITPQQEAQFAYKLANKTLPFSQKVQDEVQSMLFIEEKNGNKIYAKSGWGWDVNPQ

VGWLTGWVVQPQGNIVAFSLNLEMKKGIPSSVRKEITYKSLEQLGIL

SEQ ID No. 1181:
MNIKTLLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEMNGNKIYAKSGWGWDVDPQV

GWLTGWVVQPQGNIVAFSLNLEMKKGIPSSVRKEITYKSLEQLGIL

SEQ ID No. 1182:
MNIKALLLITSAIFISACSPYIVTANPNHSASKSDDKAEKIKNLFNEAHTTGVLVIHQGQ

TQQSYGNDLARASTEYVPASTFKMLNALIGLEHHKATTTEVFKWDGEKRLFPEWEK

NMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFPLNLEMKKGIPSSVRKEITYKSLEQLGIL

SEQ ID No. 1183:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGGDVNPQV

GWLTGWVVQPQGNIVAFSLNLEMKKGIPSSVRKEITYKSLEQLGIL

SEQ ID No. 1184:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAILVYQDLARRIGLELMSKEVKRVGYGNADIGTQVDNFWLVGPLKI

-continued

TPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1185:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1186:
MNIKALLLITSAIFISACSPYIVTANPNHSASKSDEKAEKIKNLFNEAHTTGVLVIQQGQ

TQQSYGNDLARASTEYVPASTFKMLNALIGLEHHKTTTTEVFKWDGQKRLFPEWEK

DMTLGDAMKASAIPVYQDLARRIGLELMSKEVKRVGYGNADIGTQVDNFWVVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1187:
MSKKNFILIFIFVILISCKNTEKISNETTLIDNIFTNSNAEGTLVIYNLNDDKYIIHNKERAE

QRFYPASTFKIYNSLIGLNEKAVKDVDEVFYKYNGEKVFLESWAKDSNLRYAIKNSQ

VPAYKELARRIGLKKMKENIEKLDFGNKSIGDSVDTFWLEGPLEISAMEQVKLLTKLA

QNELPYPIEIQKAVSDITILEQTYNYTLHGKTGLADSKNMTTEPIGWFVGWLEENDNI

YVFALNIDNINSDDLAKRINIVKESLKALNLLK

SEQ ID No. 1188:
MSKKNFILIFIFVILTSCKNTEKISNETTLIDNIFTNSNAEGTLVIYNLNDDKYIIHNKERA

EQRFYPASTFKIYNSLIGLNEKAVKDVDEVFYKYNGEKVFLESWAKDSNLRYAIKNS

QVPAYKELARRIGLKKMKENIEKLDFGNKSIGDSVDTFWLEGPLEISAMEQIKLLTKL

AQNELPYPIEIQKAVSDITILEQTYNYTLHGKTGLADSKNMTTEPIGWFVGWLEENDN

IYVFALNIDNINSDDLAKRINIVKESLKALNLLK

SEQ ID No. 1189:
LLITSAIFISACSPYIVSANPNHSASKSDDKAEKIKNLFNEAHTTGVLVIQQGQTQQSY

GNDLARASTEYVPASTFKMLNALIGLEHHKATTTEVFKWDGQKRLFPEWEKNMTLG

DAMKASAIPVYQDLARRIGLELMSNEVKRVGYGNADIGTQVDNFWLVGPLKITPQQ

EAQFAYKLANKTLPFSQKVQDEVQSMLFIEEKNGNKIYAKSGWGWDVDPQVGWLT

GWVVQPQGNIVAFSLNLEMKKGIPSSVRKEITYKSL

SEQ ID No. 1190:
LLITSAIFISACSPYIVSANPNHSASKSDEKAEKIKNLFNEAHTTGVLVIQQGQTQQSY

GNDLARASTEYVPASTFKMLNALIGLEHHKATTTEVFKWDGQKRLFPEWEKNMTLG

DAMKASAIPVYQDLARRIGLELMSNEVKRVGYGNADIGTQVDNFWLVGPLKITPQQ

EAQFAYKLANKTLPFSQKVQDEVQSMLFIEEKNGNKIYAKSGWGWDVNPQVGWLT

EWVVQPQGNIVAFSLNLEMKKGIPSSVRKEITYKSL

SEQ ID No. 1191:
MTVRRLSCALGAALSLSALGGGPVQAAVLCTVVADAADGRILFQQGTQQACAERYT

PASTFKLAIALMGADAGILQGPHEPVWNYQPAYPDWGGDAWRQPTDPARWIKYSV

VWYSQLTAKALGQDRFQRYTSAFGYGNADVSGEPGKHNGTDGAWIISSLRISPLEQ

LAFLRKLVNRQLPVKAAAYELAENLFEAGQADGWRLYGKTGTGSPGSNGVYTAAN

AYGWFVGWARKDGRQLVYARLLQDERATRPNAGLRARDELVRDWPAMAGAWRP

-continued

SEQ ID No. 1192:
MNIKALLLITSAIFISACSPYIVSANPNHSASKSDEKAEKIKNLFNEAHTTGVLVIQQGQ

TQQSYGNVLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

ITPQQEAQFAYKLANKTLPFSQEVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1193:
MKTFAAYVIIACLSSTALAGSITENTSWNKEFSAEAVNGVFVLCKSSSKSCATNDLAR

ASKEYLPASTFKIPSAIIGLETGVIKNEHQVFKWDGKPRAMKQWERDLTLRGAIQVS

AVPVFQQIAREVGEVRMQKYLKKFSYGNQNISGGIDKFWLEDQLRISAVNQVEFLES

LYLNKLSASKENQLIVKEALVTEAAPEYLVHSKTGFSGVGTESNPGVAWWVGWVEK

ETEVYFFAFNMDIDNESKLPLRKSIPTKIMESEGIIGG

SEQ ID No. 1194:
MNIKTLLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1195:
MNIKALLLITSAIFISACSPYIVTTNPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNTDIGTQVDNFWLVGPLKI

TPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1196:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAVPVYQDLARRIGLELMSKEVKRVGYGNADIGTQVDNFWLVGPL

KITPQQEAQFAYKLANKTLPFSQKVQDEVQSMLFIEEKNGNKIYAKSGWGWDVNQ

QVGWLTGWVVQPQGNIVAFSLNLEMKKGIPSSVRKEITYKSLEQLGIL

SEQ ID No. 1197:
MNIKTLLLITSAIFISACSPYIVTANPNHSASKSDEKAEKIKNLFNEVHTTGVLVIQQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEMTYKSLEQLGIL

SEQ ID No. 1198:
MNKYFTCYVVASLFFSGCTVQHNLINETQSQIVQGHNQVIHQYFDEKNTSGVLVIQT

DKKINLYGNALSRANTEYVPASTFKMLNALIGLENQKTDINEIFKWKGEKRSFTTWE

KDMTLGEAMKLSAVPVYQELARRIGLDLMQKEVERIDFGNAEIGQQVDNFWLIGPLK

VTPIQEVEFVSQLAHTQLPFSEKVQANVKNMLLLEENNGYKIFGKTGWAMDIKPQV

GWLTGWVEQPDGKIVAFALNMEMRSEMPASIRNELLMKSLKQLNII

SEQ ID No. 1199:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

-continued

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAAMDIKPQ

VGWLTGWVEQPDGKIVAFALNMEMRSEMPASIRNELLMKSLKQLNII

SEQ ID No. 1200:
MKTFAAYVITACLSSTALASSITENTSWNKEFSAEAVNGVFVLCKSSSKSCATNNLA

RASKEYLPASTFKIPNAIIGLETGVIKNEHQVFKWDGKPRAMKQWERDLSLRGAIQV

SAVPVFQQIAREVGEVRMQKYLKKFSYGNQNISGGIDKFLLEGQLRISAVNQVEFLE

SLFLNKLSASKENQLIVKEALVTEAAPEYLVHSKTGFSGVGTESNPGVAWWVGWVE

KGTEVYFFAFNMDIDNENKLPLRKSIPTKIMASEGIIGG

SEQ ID No. 1201:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGDADPSTSNGDYWIEGSLAISAQE

QIAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1202:
MNIKALLLITSAIFISACSPYIVTANPNHSASKSDKKAEKIKNLFNEAHTTGVLVIQQGQ

TQQSYGNDLARASTEYVPASTFKMLNALIGLEHHKASTTEVFKWNGQKRLFPEWEK

DMTLGDAMKASAIPVYQDLARRIGLELMSNEVKRVGYGNADIGTQVDNFWLVGPLK

ITPQQEAQFAYKLANKTLPFSQKVQDEVKSMLFIEEKNGNKIYAKSGWGWDVDPQV

GWLTGWVVQPQGNIVAFSLNLEMKKGIPSSVRKEITYKSLEQLGIL

SEQ ID No. 1203:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKHVGYGNADIGTQVDNFWLVGPLK

ITPQQEAQFAYKLANKTLPFSPKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1204:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKHVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1205:
MKKFILPILSISTLLSVSACSSIQTKFEDTFHTSNQQHEKAIKSYFDEAQTQGVIIIKKG

KNISTYGNNLTRAHTEYVPASTFKMLNALIGLENHKATTTEIFKWDGKKRSYPMWEK

DMTLGDAMALSAVPVYQELARRTGLDLMQKEVKRVGFGNMNIGTQVDNFWLVGPL

KITPIQEVNFADDFANNRLPFKLETQEEVKKMLLIKEFNGSKIYAKSGWGMDVTPQV

GWLTGWVEKSNGEKVAFSLNIEMKQGMPGSIRNEITYKSLENLGII

SEQ ID No. 1206:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

-continued

ITPQQEAQFAYKLANKTLPFSQEVQDEVQSILFIEEKNGNKIYAKSGWGWDVNPQV

GWLTGWVVQPQGNIVAFSLNLEMKKGIPSSVRKEITYKSLEQLGIL

SEQ ID No. 1207:
MKKFILPIFSISILVSLSACSSIKTKSEDNFHISSQQHEKAIKSYFDEAQTQGVIIIKEGK

NLSTYGNALARANKEYVPASTFKMLNALIGLENHKATTNEIFKWDGKKRTYPMWEK

DMTLGEAMALSAVPVYQELARRTGLELMQKEVKRVNFGNTNIGTQVDNFWLVGPL

KITPVQEVNFADDLAHNRLPFKLETQEEVKKMLLIKEVNGSKIYAKSGWGMGVTSQV

GWLTGWVEQANGKKIPFSLNLEMKEGMSGSIRNEITYKSLENLGII

SEQ ID No. 1208:
MRVLALSAVFLVASIIGMPAVAKEWQENKSWNAHFTEHKSQGVVVLWNENKQQGF

TNNLKRANQAFLPASTFKIPNSLIALDLGVVKDEHQVFKWDGQTRDIATWNRDHNLI

TAMKYSVVPVYQEFARQIGEARMSKMLHAFDYGNEDISGNVDSFWLDGGIRISATE

QISFLRKLYHNKLHVSERSQRIVKQAMLTEANGDYIIRAKTGYSARIEPKIGWWVGW

VELDDNVWFFAMNMDMPTSDGLGLRQAITKEVLKQEKIIP

SEQ ID No. 1209:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAVPVYQDLARRIGLELMSKEVKRVGYGNADIGTQVDNFWLVGPL

KITPQQEAQFAYKLANKTLPFSQKVQDEVQSMLFIEEKNGNKIYAKSGWGLDVNPQ

VGWLTGWVVQPQGNIVAFSLNLEMKKGIPSSVRKEITYKSLEQLGIL

SEQ ID No. 1210:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAVPVYQDLARRIGLELMSKEVKRVGYGNADIGTQVDNFWLVGPL

KITPQQEAQFAYKLANKTLPFSQKVQDEVQSMLFIEEKNGNKIYAKSGWGLDVNLQ

VGWLTGWVVQPQGNIVAFSLNLEMKKGIPSSVRKEITYKSLEQLGIL

SEQ ID No. 1211:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEKLGIL

SEQ ID No. 1212:
MNIKALLLITSAIFISACSPYIVTANPNHSASKSDVKAEKIRNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1213:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDSKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

-continued

SEQ ID No. 1214:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDGVQSMLFIEEKNGNKIYAKSGWGWDVNPQ

VGWLTGWVVQPQGNIVAFSLNLEMKKGIPSSVRKEITYKSLEQLGIL

SEQ ID No. 1215:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDSKKRLFPEWEK

DMTLGDAMKASAILVYQDLARRIGLELMSKEVKRVGYGNADIGTQVDNFWLVGPLKI

TPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1216:
MKLLKILSLVCLSISIGACAEHSMSRAKTSTIPQVNNSIIDQNVQALFNEISADAVFVTY

DGQNIKKYGTHLDRAKTAYIPASTFKIANALIGLENHKATSTEIFKWDGKPRFLKAWD

KDFTLGEAMQASTVPVYQELARRIGPSLMQSELQRIGYGNMQIGTEVDQFWLKGPL

TITPIQEVKFVYDLAQGQLPFKPEVQQQVKEMLYVERRGENRLYAKSGWGMAVDP

QVGWYVGFVEKADGQVVAFALNMQMKAGDDIALRKQLSLDVLDKLGVFHYL

SEQ ID No. 1217:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDVKPQ

VGWLTGWVEQPDGKIVAFALNMEMRSEMPASIRNELLMKSLKQLNII

SEQ ID No. 1218:
MNKYFTCYVVASLFLSGCTVQHNLINETPSQIVQGHNQVIHQYFDEKNTSGALVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALNMEMRSEMPASIRNELLMKSLKQLNII

SEQ ID No. 1219:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALNMEMRSEMPASIRNELMMKSLKQLNII

SEQ ID No. 1220:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLAGWVEQPDGKIVAFALNMEMRSEMPASIRNELLMKSLKQLNII

SEQ ID No. 1221:
MNKYFTCYVVASLFLSGCTVQHNLINETPSQIVQGHNQVIHQYFDERNTSGVLVIQT

DKKINLYGNALSRANTEYVPASTFKMLNALIGLENQKTDINEIFKWKGEKRSFTAWE

-continued

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALNMEMRSEMPASIRNELLMKSLKQLNII

SEQ ID No. 1222:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEKSNGYKIFGKTGWAMDIKPQV

GWLTGWVEQPDGKIVAFALNMEMRSEMPASIRNELLMKSLKQLNII

SEQ ID No. 1223:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALNMEMRSEMPASTRNELLMKSLKQLNII

SEQ ID No. 1224:
MKKFILPIFSISILLSLSACSSIQTKFEDTFHISNQKHEKAIKSYFDEAQTQGVIIIKEGKN

ISSYGNNLVRAHTEYVPASTFKMLNALIGLENHKATTNEIFKWDGKKRSYPMWEKD

MTLGEAMALSAVPVYQDLARRIGLNLMQKEVKRVGFGNMNIGTQVDNFWLIGPLKI

TPIQEVNFADDLANNRLPFKLETQEEVKKMLLIKEVNGSKIYAKSGWGMDVSPQVG

WLTGWVEKSNGEKVSFSLNIEMKQGMSGSIRNEITYKSLENLGII

SEQ ID No. 1225:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGQKRLFPEWEK

DMTLGDAMKASAIAVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1226:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGQKRLFPEWEK

DMTLGDAIKASAIPVYQDLARRIGLELMSKEVKRVGYGNADIGTQVDNFWLVGPLKI

TPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1227:
MKILIFLPLLSCLGLTACSLPVSSLPSQSISTQAIASLFDQAQSSGVLVIQRDQQVQVY

GNDLNRANTEYVPASTFKMLNALIGLQHGKATTNEIFKWDGKKRSFTAWEKDMTLG

QAMQASAVPVYQELARRIGLELMQQEVQRIQFGNQQIGQQVDNFWLVGPLKVTPK

QEVQFVSALAREQLAFDPQVQQQVKAMLFLQERKAYRLYVKSGWGMDVEPQVGW

LTGWVETPQAEIVAFSLNMQMQNGIDPAIRLEILQQALAELGLYPKAEG

SEQ ID No. 1228:
MHKHMSKLFIAFLAFLLSVPAAAEDQTLAELFAQQGIDGTIVISSLHNGKTFIHNDPRA

KQRFSTASTFKILNTLISLEEKAISGKDDVLKWDGHIYDFPDWNRDQTLESAFKVSCV

WCYQALARQVGAEKYRNYLRKSVYGELREPFEETTFWLDGSLQISAIEQVNFLKKV

-continued

HLRTLPFSASSYETLRQIMLIEQTPAFTLRAKTGWATRVKPQVGWYVGHVETPTDV

WFFATNIEVRDEKDLPLRQKLTRKALQAKGIIE

SEQ ID No. 1229:
MKTFAAYVITACLSSTALASSITENTSWNKEFSAEAVNGVFVLCKSSSKSCATNNLA

RASKEYLPASTFKIPNAIIGLETGVIKNEHQVFKWDGKPRAMKQWERDLSLRGAIQV

SAVPVFQQIAREVGEVRMQKYLKKFSYGNQNISGGTDKFWLEDQLRISAVNQVEFL

ESLFLNKLSASKENQLIVKEALVTEAAPEYLVHSKTGFSGVGTESNPGVAWWVGWV

EKGTEVYFFAFNMDIDNENKLPLRKSIPTKIMASEGIIGG

SEQ ID No. 1230:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAILVYQDLARRIGLELMSKEVKRVGYGNADIGTQVDNFWLVGPLKI

TPQQEAQFAYKLANKTLPFSQKVQDEVQSMLFIEEKNGNKIYAKSGWGLDVDPQV

GWLTGWVVQPQGNIVAFSLNLEMKKGIPSSVRKEITYKSLEQLGIL

SEQ ID No. 1231:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIQVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1232:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAMPVYQDLARRIGLELMSKEVKRVGYGNADIGTQVDNFWLVGPL

KITPQQEAQFAYKLANKTLPFSQKVQDEVQSMLFIEEKNGNKIYAKSGWGWDVNPQ

VGWLTGWVVQPQGNIVAFSLNLEMKKGIPSSVRKEITYKSLEQLGIL

SEQ ID No. 1233:
MNIKALLLITSAIFISACSPYIVTANPNHSASKSDEKAEKIKNLFNEVHTTGVLVIQQGQ

TQQSYGNDLARASTEYVPASTFKMLNALIGLEHHKATTTEVFKWDGKKRLFPEWEK

NMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1234:
MRVLALSAVFLVASIIGMPAVAKEWQENKSWNAHFTEHKSQGVVVLWNENKQQGF

TNNLKRANQAFLPASTFKIPNSLIALDLGVVKDEHQVFKWDGQTRDIATWNRDHNLI

TAMKYSVVPVYQEFARQIGEARMSKMLHAFDYGNEDISGNVDSFWLDGGIRISATE

QISFLRKLYHNKLHVSERSQRIVKQAMLTEANGDYIIRAKTGYDTKIGWWVGWVELD

DNVWFFAMNMDMPTSDGLGLRQAITKEVLKQEKIIP

SEQ ID No. 1235:
MSKKNFILIFIFVILISCKNTEKTSNETTLIDNIFTNSNAEGTLVIYNLNDDKYIIHNKERA

EQRFYPASTFKIYNSLIGLNEKAVKDVDEVFYKYNGEKVFLESWAKDSNLRYAIKNS

QVPAYKELARRIGLEKMKENIEKLDFGNKNIGDSVDTFWLEGPLEISAMEQVKLLTKL

AQNELPYPIEIQKAVSDITILEQTDNYTLHGKTGLADSENMTTEPIGWLVGWLEENNN

IYVFALNIDNINSDDLAKRINIVKESLKALNLLK

-continued

SEQ ID No. 1236:
MNIKALFLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1237:
MNIKALFLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPSSQKVQDEVQSMLFIEEKNGNKMYAKSGWGWDVNPQ

VGWLTGWVVQPQGNIVAFSLNLEMKKGIPSSVRKEITYKSLEQLGIL

SEQ ID No. 1238:
MNIKALFLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWVVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEIAYKSLEQLGIL

SEQ ID No. 1239:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNADPSTSNGDCWIEGSLAISAQE

QIAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1240:
MNIKTLLLITSAIFISACSPYIVTANPNHSASKSDEKAEKIKNLFNEVHTTGVLVIQQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWVVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1241:
MNIKTLLLITSAIFISACSPYIVTANPNHSASKSDEKAEKIKNLFNEVHTTGVLVIQQGQ

TQQSYGNDLARASTEYVPASTFKMLNALIGLEYHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1242:
MAIRFLTILLSTFFLTSFVHAQEHVVVRSDWKKFFSDLQAEGAIVIADERQAEHALLV

FGQERAAKRYSPASTFKLPHTLFALDAGAVRDEFQVFRWDGVKRSFAGHNQDQDL

RSAMRNSAVWVYELFAKEIGEDNARRYLKQIDYGNADPSTIKGNYWIDGNLEISAHE

QISFLRKLYRNQLPFQVEHQRLVKYLMITEAGRNWILRAKTGWEGRFGWWIGWVE

WPTGPVFFALNIDTPNRTDDLFKREAIARAILRSIDALPPN

SEQ ID No. 1243:
MRVLALSAVFLVASIIGMPAVAKEWQENKSWNAHFTEHKSQGVVVLWNENKQQGF

TNNLKRANQAFLPASTFKIPNSLIALDLGVVKDEHQVFKWDGQTRDIAAWNRDHDLI

-continued
TAMKYSVVPVYQEFARQIGEARMSKMLHAFDYGNEDISGNVDSFWLDGGIRISATQ

QIAFLRKLYHNKLHVSERSQRIVKQAMLTEANGDYIIRAKTGYSTRIEPKIGWWVGW

VELDDNVWFFAMNMDMPTSDGLGLRQAITKEVLKQEKIIP

SEQ ID No. 1244:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKSQV

GWLTGWVEQPDGKIVAFALNMEMRSEMPASIRNELLMKSLKQLNII

SEQ ID No. 1245:
MNIKALLLITSAIFISACSPYIVTANPNHSASKSDVKAEKIKNLFNEAHTTGVLVIQQGQ

TQQSYGNDLARASTEYVPASTFKMLNALIGLEHHKATTTEVFKWDGKKRLFPEWEK

DMTLGDAMKASAISVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1246:
MAIRIFAILFSIFSLATFAHAQEGTLERSDWRKFFSEFQAKGTIVVADERQADRAMLV

FDPVRSKKRYSPASTFKIPHTLFALDAGAVRDEFQIFRWDGVNRGFAGHNQDQDLR

SAMRNSTVWVYELFAKEIGDDKARRYLKKIDYGNADPSTSNGDYWIEGSLAISAQE

QIAFLRKLYRNELPFRVEHQRLVKDLMIVEAGRNWILRAKTGWEGRMGWWVGWVE

WPTGSVFFALNIDTPNRMDDLFKREAIVRAILRSIEALPPNPAVNSDAAR

SEQ ID No. 1247:
MKTIAAYLVLVFYASTALSESISENLAWNKEFSSESVHGVFVLCKSSSNSCTTNNAA

RASTAYIPASTFKIPNALIGLETGAIKDERQVFKWDGKPRAMKQWEKDLKLRGAIQV

SAVPVFQQIAREVGEIRMQKYLNLFSYGNANIGGGIDKFWLEGQLRISAFNQVKFLE

SLYLNNLPASKANQLIVKEAIVTEATPEYIVHSKTGYSGVGTESSPGVAWWVGWVE

KGTEVYFFAFNMDIDNESKLPSRKSISTKIMASEGIIIGG

SEQ ID No. 1248:
MKTFAAYVITACLSSTALASSITENTFWNKEFSAEAVNGVFVLCKSSSKLACATNNLA

RASKEYLPASTFKIPNAIIGLETGVIKNEHQIFKWDGKPRAMKQWERDLSLRGAIQVS

AVPVFQQIAREVGEVRMQKYLKKFSYGNQNISGGIDKFWLEGQLRISAVNQVEFLE

SLFLNKLSASKENQLIVKEALVTEAPEYLVHSKTGFSGVGTESNPGVAWWVGWVEK

GAEVYFFAFNMDIDNENKLPLRKSIPTKIMASEGIIGG

SEQ ID No. 1249:
MAIRIFAILFSTFVFGTFAHAQEGMRERSDWRKFFSEFQAKGTIVVADERQTDRVILV

FDQVRSEKRYSPASTFKIPHTLFALDAGAARDEFQVFRWDGIKRSFAAHNQDQDLR

SAMRNSTVWIYELFAKEIGEDKARRYLKQIDYGNADPSTSNGDYWIDGNLAIAAQEQ

IAFLRKLYHNELPFRVEHQRLVKDLMIVEAGRNWILRAKTGWEGRMGWWVGWVE

WPTGPVFFALNIDTPNRMDDLFKREAIVRAILRSIEALPPNPAVNSDAAR

SEQ ID No. 1250:
MKTFAAYVIIACLSSTALAGSITENTSWNKEFSAEAVNGVFVLCKSSSKSCATNDLAR

ASKEYLPASTFKIPNAIIGLETGVIKNEHQVFKWDGKPRAMKQWERDLTLRGAIQVS

AVPVFQQIAREVGEVRMQKYLKKFSYGSQNISGGIDKFWLEDQLRISAVNQVEFLES

-continued

LYLNKLSASKENQLIVKEALVTEAAPEYLVHSKTGFSGVGTESNPGVAWWVGWVEK

ETEVYFFAFNMDIDNESKLPLRKSIPTKIMESEGIIGG

SEQ ID No. 1251:
MNKYFTCYVVASLFLSGCTVQHNLINETPSQIVQGHNQVIHQYFDEKNTSGVLVIQT

DKKINLYGNALSRANTEYVPASTFKMLNALIGLENQKTDINEIFKWKGEKRSFTAWE

KDMTLGEAMKLSAVPVYQELARRIGLDLMQKEVKRIGFGNAEIGQQVDNFWLVGPL

KVTPIQEVEFVSQLAHTQLPFSEKVQANVKNMLLLEESNGYKIFGKTGWAMDIKPQV

GWLTGWVEQPDGKIVAFALNMEMRSEMPASIRNELLMKSLKQLNII

SEQ ID No. 1252:
MKKLSVLLWLTLFYCGTIWAQSTCFLVQENQTVLKHEGKDCNKRFAPESTFKIALSL

MGFDSGILKDTLNPEWPYKKEYELYLNVWKYPHNPRTWIRDSCVWYSQVLTQQLG

MTRFKNYVDAFHYGNQDISGDKGQNNGLTHSWLSSSLAISPSEQIQFLQKIVNKKLS

VNPKAFTMTKDILYIQELAGGWKLYGKTGNGRQLTKDKSQKLSLQHGWFIGWIEKD

GRVITFTKHIADSKKHVTFASFRAKNETLNQLFYLINELEK

SEQ ID No. 1253:
MNIKTLLLITSAIFISACSPYIVTANPNHSASKSDEKAEKIKNLFNEVHTTGVLVIQQGQ

TQQSYGNDLARASTEYVPASTFKMLNALIGLEHHKATTTEVFKWDGQKRLFPEWEK

DMTLGDAMKASAIPVYQDLARRIGLELMSKEVKRVGYGNADIGTQVDNFWLVGPLK

ITPQQEAQFAYKLANKTLPFSPKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1254:
MKFRHALSSAFVLLGCIAASAHAKTICTAIADAGTGKLLVQDGDCGRRASPASTFKIA

ISLMGYDAGFLRNEHDPVLPYRDSYIAWGGEAWKQPTDPTRWLKYSVVWYSQQV

AHHLGAQRFAQYAKAFGYGNADVSGDPGQNNGLDRAWIGSSLQISPLEQLEFLGK

MLNRKLPVSPTAVDMTERIVESTTLADGTVVHGKTGVSYPLLADGTRDWARGSGW

FVGWIVRGNQTLVFARLTQDERKQPVSAGIRTREAFLRDLPRLLAAR

SEQ ID No. 1255:
MKFRHALSSAFVLLGCIAASAHAKTICTAIADAGTGKLLVQDGDCGRRASPASTFKIA

ISLMGYDAGFLRNEHDPVLPYRDSYIAWGGEAWKQPTDPTRWLKYPVVWYSQQV

AHHLGAQRFAQYAKAFGYGNADVSGDPGQNNGLDRAWIGSSLQISPLEQLEFLGK

MLNRKLPVSPTAVDMTERIVESTTLADGTVVHGKTGVSYPLLADGTRDWARGSGW

FVGWIVRGKQTLVFARLTQDERKQPVSAGIRTREAFLRDLPRLLAAR

SEQ ID No. 1256:
MRGKHTVILGAALSALFAGAAGAQMLECTLVADAASGQELYRKGACDKAFAPMSTF

KVPLAVMGYDAGILVDAHNPRWDYKPEFNGYKFQQKTTDPTIWEKDSIVWYSQQLT

RKMGQKRFAAYVAGFGYGNGDISGEPGKSNGLTHSWLGSSLKISPEGQVRFVRDL

LSAKLPASKDAQQMTVSILPHFAAGDWAVQGKTGTGSFIDARGAKAPLGWFIGWAT

HEERRVVFARMTAGGKKGEQPAGPAARDAFLKALPDLAKRF

SEQ ID No. 1257:
MKFRHALSSAFVLLGCIAASAHAKTICTAIADAGTGKLLVQDGDCGRRASPASTFKIA

ISLMGYDAGFLRNEHDPVLPYRDSYIAWGGEAWKQPTDPTRWLKYSVVWYSQQV

AHHLGAQRFAQYAKAFGYGNADVSGDPGQNNGLDRAWIGSSLQISPLEQLEFLGK

MLDRKLPVSPTAVDMTERIVESTTLADGTVVHGKTGVSYPLLADGTRDWARGSGW

FVGWIVRGKQTLVFARLTQDERKQPVSAGIRTREAFLRDLPRLLAAR

-continued

SEQ ID No. 1258:
MKFRHALSSAFVLLGCIAASAHAKTICTAIADAGTGKLLVQDGDCGRRASPASTFKIA

ISLMGYDAGFLRNEHDPVLPYRDSYIAWGGEAWKQPTDPTRWLKYSVVWYSQQV

AHHLGAQRFAQYAKAFGYGNADVSGDPGQNNGLDRAWIGSSLQISPLEQLEFLGK

MLNRKLPVSPTAVDMTERIVESTTLADGTVVHGKTGVSYPLLADGTRDWARGSGW

FVGWIVRGKQTLVFARLTQDERKQPVSAGIRTREAFLRDLPRLLAAR

SEQ ID No. 1259:
MKTFAAYVIIACLSSTALAGSITENTSWNKEFSAEAVNGVFVLCKSSSKSCATNDLAR

ASKEYLPVSTFKIPSAIIGLETGVIKNEHQVFKWDGKPRAMKQWERDLTLRGAIQVS

AVPVFQQIAREVGEVRMQKYLKKFSYGNQNISGGIDKFWLEGQLRISAVNQVEFLE

SLYLNKLSASKENQLIVKEALVTEAAPEYLVHSKTGFSGVGTESNPGVAWWVGWVE

KETEVYFFAFNMDIDNESKLPLRKSIPTKIMESEGIIGG

SEQ ID No. 1260:
MNIKALLLITSAIFISACSPYIVTANPNHSASKSDEKAEKIKNLFNEAHTTGVLVIQQGQ

TQQSYGNDLARASTEYVPASTFKMLNALIGLEHHKATTTEVFKWDGKKRLFPEWEK

DMTLGDAMKASAIPVYQDLARRIGLELMSKEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1261:
MNIKALLLITSAIFISACSPYIVSANPNHSASKSDEKAEKIKNLFNEAHTTGVLVIQQGQ

TQQSYGNDLARASTEYVPASTFKMLNALIGLEHHKATTTEVFKWDGQKRLFPEWEK

NMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVNPQV

GWLTGWVVQPQGNIVAFSLNLEMKKGIPSSVRKEITYKSLEQLGIL

SEQ ID No. 1262:
MKTFAAYVITACLSSTALASSITENTFWNKEFSAEAVNGVFVLCKSSSKSCATNNLA

RASKEYLPASTFKIPNAIIGLETGVIKNEHQVFKWDGKPRAMKQWERDLSLRGAIQV

SAVPVFQQIAREVGEVRMQKYLKKFSYGNQNISGGIDKFWLEGQLRISAVNQVEFL

ESLFLNKLSASKENQLIVKEALVTEAAPEYLVHSKTGFSGVGTESNPGVAWWVGWV

EKGTEVYFFAFNMDIDNENKLPLRKSIPTKIMASEGIIGG

SEQ ID No. 1263:
MKTIAAYLVLVFFAGTALSESISENLAWNKEFSSESVHGVFVLCKSSSNSCTTNNAT

RASTAYIPASTFKIPNALIGLETGAIKDARQVFKWDGKPRAMKQWEKDLTLRGAIQV

SAVPVFQQIARDIGKKRMQKYLNLFSYGNANIGGGIDKFWLEGQLRISAVNQVKFLE

SLYLNNLPASKANQLIVKEAIVTEATPEYIVHSKTGYSGVGTESNPGVAWWVGWVE

KGTEVYFFAFNMDIDNESKLPSRKSIPTKIMASEGIIIGG

SEQ ID No. 1264:
MKKFILPIFSISILVSLSACSSIKTKSEDNFHISSQQHEKAIKSYFDEAQTQGVIIIKEGK

NLSTYGNALARANKEYVPASTFKMLIALIGLENHKATTNEIFKWDGKKRTYPMWEKD

MTLGEAMALSAVPVYQELARRTGLELMQKEVKRVNFGNTNIGTQVDNFWLVGPLKI

TPVQEVNFADDLAHNRLPFKLETQEEVKKMLLIKEVNGSKIYAKSGWGMGVTPQVG

WLTGWVEQANGKKIPFSLNLEMKEGMSGSIRNEITYKSLENLGII

SEQ ID No. 1265:
MNIKALLLITSAIFISACSPYIVTANPNHSASKSDDKAEKIKNLFNEAHTTGVLVIHGQ

TQQSYGNDLARASTEYVPASTFKMLNALIGLEHHKATTTEVFKWNGQKRLFPEWEK

-continued

```
DMTLGDAMKASAIPVYQDLARRIGLELMSNEVKRVGYGNADIGTQVDNFWLVGPLK

ITPQQEAQFAYKLANKTLPFSQKVQDEVQSMLFIEEKNGNKIYAKSGWGWDVDPQV

GWLTGWVVQPQGNIVAFSLNLEMKKGIPSSVRKEITYKSLEQLGIL

SEQ ID No. 1266:
MNIKALLLITSAISISACSPYIVTANPNHSASKSDEKAEKIKNLFNEAHTTGVLVIQQGQ

TQQSYGNDLARASTEYVPASTFKMLNALIGLEHHKATTTEVFKWDGQKRLFPEWEK

DMTLGDAIKASAIPVYQDLARRIGLELMSKEVKRVGYGNADIGTQVDNFWLVGPLKI

TPQQEAQFAYKLANKTLPFSQKVQDEVQSMLFIEEKNGNKIYAKSGWGWDVDPQV
``` said peptides being chosen, preferably, from the peptides of sequence SEQ ID No. 1267 to SEQ ID No. 1835 and SEQ ID No. 2160 to SEQ ID No. 2171 as defined hereafter:

| Peptide SEQ ID No. | Amino acid sequence | Position of the peptide in the OXA protein(s) | Clinical interest |
|---|---|---|---|
| SEQ ID No. 1267 | AAAYELAENLFEAGQADGWR | 183-202 for the proteins of SEQ No. 1191 | 2d |
| SEQ ID No. 1268 | AAEGFIPASTFK | 86-97 for the proteins of SEQ No. 1139 | 2df |
| SEQ ID No. 1269 | AALGR | 41-45 for the proteins of SEQ No. 1140 | 2df |
| SEQ ID No. 1270 | ADGQVVAFALNMQMK | 241-255 for the proteins of SEQ No. 1168, 1171, 1216 | 2df |
| SEQ ID No. 1271 | ADINEIFK | 95-102 for the proteins of SEQ No. 1124 | 2df |
| SEQ ID No. 1272 | ADWGK | 50-54 for the proteins of SEQ No. 1140 | 2df |
| SEQ ID No. 1273 | AEGAIVISDER | 40-50 for the proteins of SEQ No. 1127, 1130 | OXA |
| SEQ ID No. 1274 | AFALNLDIDK | 222-231 for the proteins of SEQ No. 1143 | 2d |
| SEQ ID No. 1275 | AFAPMSTFK | 49-57 for the proteins of SEQ No. 1256; 60-68 for the protein of sequence SEQ ID No. 1109 | OXA |
| SEQ ID No. 1276 | AFGYGNADVSGDPGQNNGLDR | 127-147 for the proteins of SEQ No. 1254, 1255, 1257, 1258 | 2d |
| SEQ ID No. 1277 | AFTMTK | 174-179 for the proteins of SEQ No. 1252 | 2de |
| SEQ ID No. 1278 | AGDDIALR | 256-263 for the proteins of SEQ No. 1168, 1171, 1216 | 2df |
| SEQ ID No. 1279 | AGHVYAFALNIDMPR | 233-247 for the proteins of SEQ No. 1137 | 2df |
| SEQ ID No. 1280 | AGLWR | 11-15 for the proteins of SEQ No. 1140 | 2df |
| SEQ ID No. 1281 | AHTEYVPASTFK | 73-84 for the proteins of SEQ No. 1205, 1224 | 2df |
| SEQ ID No. 1282 | AIIPWDGK | 112-119 for the proteins of SEQ No. 1140 | 2df |
| SEQ ID No. 1283 | AIIPWDGKPR | 112-121 for the proteins of SEQ No. 1140 | 2df |
| SEQ ID No. 1284 | AISDITITR | 190-198 for the proteins of SEQ No. 1144 | 2d |

-continued

| Peptide SEQ ID No. | Amino acid sequence | Position of the peptide in the OXA protein(s) | Clinical interest |
|---|---|---|---|
| SEQ ID No. 1285 | AISGK | 82-86 for the proteins of SEQ No. 1228 | 2df |
| SEQ ID No. 1286 | ALGQDR | 121-126 for the proteins of SEQ No. 1191 | 2d |
| SEQ ID No. 1287 | ALPDLAK | 256-262 for the proteins of SEQ No. 1256 | 2d |
| SEQ ID No. 1288 | ALQAK | 254-258 for the proteins of SEQ No. 1228 | 2df |
| SEQ ID No. 1289 | AMETFSPASTFK | 50-61 for the proteins of SEQ No. 1143 | 2d |
| SEQ ID No. 1290 | AMLFLQER | 196-203 for the proteins of SEQ No. 1227 | 2df |
| SEQ ID No. 1291 | AMLVFDPVR | 55-63 for the proteins of SEQ No. 1108, 1125, 1128, 1173, 1201, 1239, 1246; 44-52 for the protein of sequence SEQ ID No. 1120 | OXA |
| SEQ ID No. 1292 | AMTLLESGPGWELHGK | 189-204 for the proteins of SEQ No. 1138 | 2d |
| SEQ ID No. 1293 | ANLHITLHGK | 199-208 for the proteins of SEQ No. 1144 | 2d |
| SEQ ID No. 1294 | ANQLIVK | 183-189 for the proteins of SEQ No. 1247, 1263 | OXA |
| SEQ ID No. 1295 | ANTEYVPASTFK | 71-82 for the proteins of SEQ No. 1124, 1132, 1145, 1198, 1199, 1217, 1218, 1219, 1220, 1221, 1222, 1223, 1244, 1251; 66-77 for the protein of sequence SEQ ID No. 1227 | 2df |
| SEQ ID No. 1296 | ANVSR | 133-137 for the proteins of SEQ No. 1138 | 2d |
| SEQ ID No. 1297 | APIGWFIGWATR | 224-235 for the proteins of SEQ No. 1109 | 2de |
| SEQ ID No. 1298 | APLGWFIGWATHEER | 213-227 for the proteins of SEQ No. 1256 | 2d |
| SEQ ID No. 1299 | AQDEVQSMLFIEEK | 196-209 for the proteins of SEQ No. 1161 | 2df |
| SEQ ID No. 1300 | AQGVIVLWNENK | 40-51 for the proteins of SEQ No. 1142 | 2df |
| SEQ ID No. 1301 | ASAIAVYQDLAR | 126-137 for the proteins of SEQ No. 1225 | 2df |
| SEQ ID No. 1302 | ASAILVYQDLAR | 126-137 for the proteins of SEQ No. 1175, 1184, 1215, 1230 | 2df |
| SEQ ID No. 1303 | ASAIPVYQDLAR | 126-137 for the proteins of SEQ No. 1146, 1147, 1148, 1149, 1150, 1151, 1152, 1153, 1154, 1156, 1157, 1160, 1161, 1162, 1163, 1164, 1165, 1166, 1167, 1169, 1170, 1174, 1176, 1177, 1178, 1181, 1182, 1183, 1185, 1186, 1192, 1194, 1195, 1197, 1202, 1203, 1204, 1206, 1211, 1212, 1213, 1214, 1226, 1233, 1236, 1237, 1238, 1240, 1241, 1253, 1260, 1261, 1265, 1266; 120-131 for the protein of sequence SEQ ID No. 1189; 120-131 for the protein of sequence SEQ ID No. 1190 | 2df |
| SEQ ID No. 1304 | ASAIPVYQDLPR | 126-137 for the proteins of SEQ No. 1155 | 2df |
| SEQ ID No. 1305 | ASAIQVYQDLAR | 126-137 for the proteins of SEQ No. 1179, 1231 | 2df |

-continued

| Peptide SEQ ID No. | Amino acid sequence | Position of the peptide in the OXA protein(s) | Clinical interest |
|---|---|---|---|
| SEQ ID No. 1306 | ASAISVYQDLAR | 126-137 for the proteins of SEQ No. 1158, 1245 | 2df |
| SEQ ID No. 1307 | ASALPVYQDLAR | 126-137 for the proteins of SEQ No. 1159, 1180 | 2df |
| SEQ ID No. 1308 | ASAMPVYQDLAR | 126-137 for the proteins of SEQ No. 1232 | 2df |
| SEQ ID No. 1309 | ASAVPVYQDLAR | 126-137 for the proteins of SEQ No. 1196, 1209, 1210 | 2df |
| SEQ ID No. 1310 | ASIEYVPASTFK | 72-83 for the proteins of SEQ No. 1157, 1161 | 2df |
| SEQ ID No. 1311 | ASNVPVYQELAR | 113-124 for the proteins of SEQ No. 1138 | 2d |
| SEQ ID No. 1312 | ASPASTFK | 49-56 for the proteins of SEQ No. 1254, 1255, 1257, 1258 | 2d |
| SEQ ID No. 1313 | ASTAYIPASTFK | 59-70 for the proteins of SEQ No. 1247, 1263 | OXA |
| SEQ ID No. 1314 | ASTEYVPASTFK | 72-83 for the proteins of SEQ No. 1146, 1147, 1148, 1149, 1150, 1151, 1152, 1153, 1154, 1155, 1156, 1158, 1159, 1160, 1162, 1163, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 66-77 for the protein of sequence SEQ ID No. 1189; 66-77 for the protein of sequence SEQ ID No. 1190 | 2df |
| SEQ ID No. 1315 | ASTTEVFK | 96-103 for the proteins of SEQ No. 1202 | 2df |
| SEQ ID No. 1316 | ATSTEIFK | 99-106 for the proteins of SEQ No. 1168, 1171, 1216 | 2df |
| SEQ ID No. 1317 | ATTNEIFK | 97-104 for the proteins of SEQ No. 1122, 1123, 1129, 1172, 1207, 1224, 1264; 90-97 for the protein of sequence SEQ ID No. 1227 | 2df |
| SEQ ID No. 1318 | ATTTAVFK | 96-103 for the proteins of SEQ No. 1154 | 2df |
| SEQ ID No. 1319 | ATTTEIFK | 97-104 for the proteins of SEQ No. 1205; 96-103 for the protein of sequence SEQ ID No. 1157; 96-103 for the protein of sequence SEQ ID No. 1161; 96-103 for the protein of sequence SEQ ID No. 1169 | 2df |
| SEQ ID No. 1320 | ATTTEVFK | 96-103 for the proteins of SEQ No. 1146, 1147, 1148, 1149, 1150, 1151, 1152, 1155, 1156, 1158, 1159, 1160, 1162, 1163, 1165, 1166, 1167, 1170, 1174, 1175, 1176, 1177, 1178, 1179, 1180, 1181, 1182, 1183, 1184, 1185, 1192, 1194, 1195, 1196, 1197, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 90-97 for the protein of sequence SEQ ID No. 1189; 90-97 for the protein of sequence SEQ ID No. 1190 | 2df |
| SEQ ID No. 1321 | AVSDITILEQTDNYTLHGK | 191-209 for the proteins of SEQ No. 1235 | OXA |
| SEQ ID No. 1322 | AVSDITILEQTYNYTLHGK | 191-209 for the proteins of SEQ No. 1187, 1188 | 2d |

-continued

| Peptide SEQ ID No. | Amino acid sequence | Position of the peptide in the OXA protein(s) | Clinical interest |
|---|---|---|---|
| SEQ ID No. 1323 | AVVPHFEAGDWDVQGK | 195-210 for the proteins of SEQ No. 1109 | 2de |
| SEQ ID No. 1324 | AWEHDMSLR | 100-108 for the proteins of SEQ No. 1138 | 2d |
| SEQ ID No. 1325 | AWIGSSLQISPLEQLEFLGK | 148-167 for the proteins of SEQ No. 1254, 1255, 1257, 1258 | 2d |
| SEQ ID No. 1326 | CAAQMAPDSTFK | 63-74 for the proteins of SEQ No. 1134 | 2d |
| SEQ ID No. 1327 | CATQMAPDSTFK | 48-59 for the proteins of SEQ No. 1119; 63-74 for the protein of sequence SEQ ID No. 1118 | 2d |
| SEQ ID No. 1328 | CTIIADAITGNTLYETGECAR | 32-52 for the proteins of SEQ No. 1107 | 2d |
| SEQ ID No. 1329 | DAFLK | 251-255 for the proteins of SEQ No. 1256 | 2d |
| SEQ ID No. 1330 | DDFILHGK | 189-196 for the proteins of SEQ No. 1135 | 2d |
| SEQ ID No. 1331 | DDQEVLPYGGK | 92-102 for the proteins of SEQ No. 1137 | 2df |
| SEQ ID No. 1332 | DDVLK | 87-91 for the proteins of SEQ No. 1228 | 2df |
| SEQ ID No. 1333 | DEFHVFR | 90-96 for the proteins of SEQ No. 1113, 1121 | 2d |
| SEQ ID No. 1334 | DEFQIFR | 90-96 for the proteins of SEQ No. 1108, 1125, 1128, 1133, 1173, 1201, 1239, 1246; 79-85 for the protein of sequence SEQ ID No. 1120 | OXA |
| SEQ ID No. 1335 | DEFQVFR | 90-96 for the proteins of SEQ No. 1114, 1127, 1130, 1131, 1242, 1249 | 2d |
| SEQ ID No. 1336 | DELVR | 260-264 for the proteins of SEQ No. 1191 | 2d |
| SEQ ID No. 1337 | DETSR | 112-116 for the proteins of SEQ No. 1139 | 2df |
| SEQ ID No. 1338 | DFDYGNQDFSGDK | 141-153 for the proteins of SEQ No. 1118, 1134; 126-138 for the protein of sequence SEQ ID No. 1119 | 2d |
| SEQ ID No. 1339 | DFTLGEAMQASTVPVYQELAR | 120-140 for the proteins of SEQ No. 1168, 1171, 1216 | 2df |
| SEQ ID No. 1340 | DGNITSVAINIDMLSEADAPK | 250-270 for the proteins of SEQ No. 1140 | 2df |
| SEQ ID No. 1341 | DHDLITAMK | 108-116 for the proteins of SEQ No. 1142, 1243 | 2df |
| SEQ ID No. 1342 | DIAAWNR | 101-107 for the proteins of SEQ No. 1142, 1243 | 2df |
| SEQ ID No. 1343 | DIGEDK | 131-136 for the proteins of SEQ No. 1131 | 2d |
| SEQ ID No. 1344 | DILYIQELAGGWK | 180-192 for the proteins of SEQ No. 1252 | 2de |
| SEQ ID No. 1345 | DITILEK | 181-187 for the proteins of SEQ No. 1135 | 2d |
| SEQ ID No. 1346 | DLLSAK | 166-171 for the proteins of SEQ No. 1256 | 2d |

-continued

| Peptide SEQ ID No. | Amino acid sequence | Position of the peptide in the OXA protein(s) | Clinical interest |
|---|---|---|---|
| SEQ ID No. 1347 | DLMITEAGR | 195-203 for the proteins of SEQ No. 1127, 1130, 1131 | 2d |
| SEQ ID No. 1348 | DLMIVEAGR | 195-203 for the proteins of SEQ No. 1108, 1114, 1125, 1128, 1133, 1173, 1201, 1239, 1246, 1249; 184-192 for the protein of sequence SEQ ID No. 1120 | OXA |
| SEQ ID No. 1349 | DLMIVEAK | 195-202 for the proteins of SEQ No. 1113, 1121 | 2d |
| SEQ ID No. 1350 | DLPLR | 243-247 for the proteins of SEQ No. 1228 | 2df |
| SEQ ID No. 1351 | DLSGNPGK | 131-138 for the proteins of SEQ No. 1105 | 2d |
| SEQ ID No. 1352 | DLSLR | 105-109 for the proteins of SEQ No. 1115, 1116, 1117, 1126, 1141, 1200, 1229, 1262; 106-110 for the protein of sequence SEQ ID No. 1248 | OXA |
| SEQ ID No. 1353 | DLTLR | 105-109 for the proteins of SEQ No. 1110, 1193, 1250, 1259, 1263; 96-100 for the protein of sequence SEQ ID No. 1106; 96-100 for the protein of sequence SEQ ID No. 1111; 96-100 for the protein of sequence SEQ ID No. 1112 | OXA |
| SEQ ID No. 1354 | DMTLGDAIK | 117-125 for the proteins of SEQ No. 1226, 1266 | 2df |
| SEQ ID No. 1355 | DMTLGDAMALSAVPVYQELAR | 118-138 for the proteins of SEQ No. 1205 | 2df |
| SEQ ID No. 1356 | DMTLGDAMK | 117-125 for the proteins of SEQ No. 1147, 1148, 1149, 1152, 1153, 1156, 1157, 1158, 1159, 1161, 1162, 1165, 1166, 1167, 1169, 1170, 1175, 1176, 1178, 1179, 1181, 1183, 1184, 1185, 1186, 1194, 1195, 1196, 1197, 1202, 1209, 1210, 1211, 1212, 1213, 1214, 1215, 1225, 1230, 1231, 1232, 1236, 1237, 1238, 1240, 1241, 1245, 1253, 1260, 1265 | 2df |
| SEQ ID No. 1357 | DMTLGEAMALSAVPVYQDLAR | 118-138 for the proteins of SEQ No. 1224 | 2df |
| SEQ ID No. 1358 | DMTLGEAMALSAVPVYQELAR | 118-138 for the proteins of SEQ No. 1122, 1123, 1129, 1172, 1207, 1264 | 2df |
| SEQ ID No. 1359 | DMTLGEAMK | 116-124 for the proteins of SEQ No. 1124, 1132, 1145, 1198, 1199, 1217, 1218, 1219, 1220, 1221, 1222, 1223, 1244, 1251 | 2df |
| SEQ ID No. 1360 | DMTLGQAMQASAVPVYQELAR | 111-131 for the proteins of SEQ No. 1227 | 2df |
| SEQ ID No. 1361 | DNNGK | 214-218 for the proteins of SEQ No. 1107 | 2d |
| SEQ ID No. 1362 | DQDLR | 110-114 for the proteins of SEQ No. 1108, 1114, 1125, 1127, 1128, 1130, 1131, 1133, 1173, 1201, 1239, 1242, 1246, 1249; 99-103 for the protein of sequence SEQ ID No. 1120 | 2d |
| SEQ ID No. 1363 | DQQIGWFVGWASK | 213-225 for the proteins of SEQ No. 1105 | 2d |
| SEQ ID No. 1364 | DQQIGWFVGWASKPGK | 213-228 for the proteins of SEQ No. 1105 | 2d |
| SEQ ID No. 1365 | DQQVQVYGNDLNR | 53-65 for the proteins of SEQ No. 1227 | 2df |
| SEQ ID No. 1366 | DQSFR | 132-136 for the proteins of SEQ No. 1139 | 2df |

| Peptide SEQ ID No. | Amino acid sequence | Position of the peptide in the OXA protein(s) | Clinical interest |
|---|---|---|---|
| SEQ ID No. 1367 | DQTLESAFK | 105-113 for the proteins of SEQ No. 1228 | 2df |
| SEQ ID No. 1368 | DSCVWYSQVLTQQLGMTR | 98-115 for the proteins of SEQ No. 1252 | 2de |
| SEQ ID No. 1369 | DSIVWYSQELTR | 113-124 for the proteins of SEQ No. 1109 | 2de |
| SEQ ID No. 1370 | DSIVWYSQQLTR | 102-113 for the proteins of SEQ No. 1256 | 2d |
| SEQ ID No. 1371 | DSNLR | 109-113 for the proteins of SEQ No. 1187, 1188, 1235; 96-100 for the protein of sequence SEQ ID No. 1135; 108-112 for the protein of sequence SEQ ID No. 1144 | 2d |
| SEQ ID No. 1372 | DSYIAWGGEAWK | 81-92 for the proteins of SEQ No. 1254, 1255, 1257, 1258 | 2d |
| SEQ ID No. 1373 | DTLNPEWPYK | 67-76 for the proteins of SEQ No. 1252 | 2de |
| SEQ ID No. 1374 | DVDEVFYK | 88-95 for the proteins of SEQ No. 1144, 1187, 1188, 1235 | 2d |
| SEQ ID No. 1375 | DVSGDPGK | 144-151 for the proteins of SEQ No. 1109 | 2de |
| SEQ ID No. 1376 | DWILR | 204-208 for the proteins of SEQ No. 1113, 1121 | 2d |
| SEQ ID No. 1377 | DWPAMAGAWR | 265-274 for the proteins of SEQ No. 1191 | 2d |
| SEQ ID No. 1378 | EAFLR | 256-260 for the proteins of SEQ No. 1254, 1255, 1257, 1258 | 2d |
| SEQ ID No. 1379 | EAIAR | 250-254 for the proteins of SEQ No. 1113, 1121, 1127, 1130, 1131, 1133, 1242 | 2d |
| SEQ ID No. 1380 | EAIVR | 250-254 for the proteins of SEQ No. 1108, 1114, 1125, 1128, 1173, 1201, 1239, 1246, 1249; 239-243 for the protein of sequence SEQ ID No. 1120 | OXA |
| SEQ ID No. 1381 | EAIVTEATPEYIVHSK | 190-205 for the proteins of SEQ No. 1247, 1263 | OXA |
| SEQ ID No. 1382 | EALVTEAAPEYLVHSK | 190-205 for the proteins of SEQ No. 1110, 1115, 1116, 1117, 1126, 1141, 1193, 1200, 1229, 1250, 1259, 1262; 181-196 for the protein of sequence SEQ ID No. 1106; 181-196 for the protein of sequence SEQ ID No. 1111; 181-196 for the protein of sequence SEQ ID No. 1112 | OXA |
| SEQ ID No. 1383 | EALVTEAPEYLVHSK | 191-205 for the proteins of SEQ No. 1248 | 2d |
| SEQ ID No. 1384 | EEIVR | 240-244 for the proteins of SEQ No. 1135 | 2d |
| SEQ ID No. 1385 | EEVLAALPAQLK | 251-262 for the proteins of SEQ No. 1105 | 2d |
| SEQ ID No. 1386 | EFNGSK | 209-214 for the proteins of SEQ No. 1205 | 2df |
| SEQ ID No. 1387 | EFSAEAVNGVFVLCK | 31-45 for the proteins of SEQ No. 1110, 1115, 1116, 1117, 1126, 1141, 1193, 1200, 1229, 1248, 1250, 1259, 1262; 22-36 for the protein of sequence SEQ ID No. 1106; 22-36 for the protein of sequence SEQ ID No. 1111; 22-36 for the protein of sequence SEQ ID No. 1112 | OXA |

-continued

| Peptide SEQ ID No. | Amino acid sequence | Position of the peptide in the OXA protein(s) | Clinical interest |
|---|---|---|---|
| SEQ ID No. 1388 | EFSSESVHGVFVLCK | 31-45 for the proteins of SEQ No. 1247, 1263 | OXA |
| SEQ ID No. 1389 | EGDMAK | 248-253 for the proteins of SEQ No. 1137 | 2df |
| SEQ ID No. 1390 | EGMSGSIR | 254-261 for the proteins of SEQ No. 1122, 1129, 1172, 1207, 1264 | 2df |
| SEQ ID No. 1391 | EGMTGSIR | 254-261 for the proteins of SEQ No. 1123 | 2df |
| SEQ ID No. 1392 | EGSCDK | 54-59 for the proteins of SEQ No. 1109 | 2de |
| SEQ ID No. 1393 | EIAVWNR | 125-131 for the proteins of SEQ No. 1139 | 2df |
| SEQ ID No. 1394 | EIAYK | 262-266 for the proteins of SEQ No. 1238 | 2df |
| SEQ ID No. 1395 | EIFER | 20-24 for the proteins of SEQ No. 1135 | 2d |
| SEQ ID No. 1396 | EIFYHYR | 79-85 for the proteins of SEQ No. 1143 | 2d |
| SEQ ID No. 1397 | EIGDDK | 131-136 for the proteins of SEQ No. 1108, 1125, 1128, 1173, 1201, 1239, 1246; 120-125 for the protein of sequence SEQ ID No. 1120 | OXA |
| SEQ ID No. 1398 | EIGDGK | 131-136 for the proteins of SEQ No. 1133 | 2d |
| SEQ ID No. 1399 | EIGEDK | 131-136 for the proteins of SEQ No. 1114, 1130, 1249 | 2d |
| SEQ ID No. 1400 | EIGEDNAR | 131-138 for the proteins of SEQ No. 1242 | OXA |
| SEQ ID No. 1401 | EIGENK | 131-136 for the proteins of SEQ No. 1113, 1121 | 2d |
| SEQ ID No. 1402 | EIGPK | 153-157 for the proteins of SEQ No. 1139 | 2df |
| SEQ ID No. 1403 | EIGSEIDK | 136-143 for the proteins of SEQ No. 1135 | 2d |
| SEQ ID No. 1404 | EITYK | 262-266 for the proteins of SEQ No. 1147, 1148, 1149, 1150, 1151, 1152, 1153, 1154, 1155, 1156, 1157, 1158, 1159, 1160, 1161, 1162, 1163, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1202, 1203, 1204, 1206, 1209, 1210, 1211, 1212, 1213, 1214, 1215, 1225, 1226, 1230, 1231, 1232, 1233, 1236, 1237, 1240, 1241, 1245, 1253, 1260, 1261, 1265, 1266; 263-267 for the protein of sequence SEQ ID No. 1122; 263-267 for the protein of sequence SEQ ID No. 1123; 263-267 for the protein of sequence SEQ ID No. 1129; 263-267 for the protein of sequence SEQ ID No. 1172; 256-260 for the protein of sequence SEQ ID No. 1189; 256-260 for the protein of sequence SEQ ID No. 1190; 263-267 for the protein of sequence SEQ ID No. 1205; 263-267 for the protein of sequence SEQ ID No. 1207; 263-267 for the protein of sequence SEQ ID No. 1224; 263-267 for the protein of sequence SEQ ID No. 1264 | 2df |
| SEQ ID No. 1405 | EITYR | 262-266 for the proteins of SEQ No. 1146 | 2df |

-continued

| Peptide SEQ ID No. | Amino acid sequence | Position of the peptide in the OXA protein(s) | Clinical interest |
|---|---|---|---|
| SEQ ID No. 1406 | EMIYLK | 181-186 for the proteins of SEQ No. 1143 | 2d |
| SEQ ID No. 1407 | EMLYVER | 205-211 for the proteins of SEQ No. 1168, 1171, 1216 | 2df |
| SEQ ID No. 1408 | EMTYK | 262-266 for the proteins of SEQ No. 1197 | 2df |
| SEQ ID No. 1409 | ENIEK | 138-142 for the proteins of SEQ No. 1187, 1188, 1235; 137-141 for the protein of sequence SEQ ID No. 1144 | 2d |
| SEQ ID No. 1410 | ENQLIVK | 183-189 for the proteins of SEQ No. 1110, 1115, 1116, 1117, 1126, 1141, 1193, 1200, 1229, 1250, 1259, 1262; 174-180 for the protein of sequence SEQ ID No. 1106; 174-180 for the protein of sequence SEQ ID No. 1111; 174-180 for the protein of sequence SEQ ID No. 1112; 184-190 for the protein of sequence SEQ ID No. 1248 | OXA |
| SEQ ID No. 1411 | EQAILLFR | 156-163 for the proteins of SEQ No. 1143 | 2d |
| SEQ ID No. 1412 | EQIQFLLR | 165-172 for the proteins of SEQ No. 1107 | 2d |
| SEQ ID No. 1413 | EQLAPDPQVQQQVK | 182-195 for the proteins of SEQ No. 1227 | 2df |
| SEQ ID No. 1414 | EQVDFVQR | 189-196 for the proteins of SEQ No. 1140 | 2df |
| SEQ ID No. 1415 | ETEVYFFAFNMDIDNESK | 229-246 for the proteins of SEQ No. 1110, 1193, 1250, 1259; 220-237 for the protein of sequence SEQ ID No. 1106; 220-237 for the protein of sequence SEQ ID No. 1111; 220-237 for the protein of sequence SEQ ID No. 1112 | OXA |
| SEQ ID No. 1416 | ETTTPR | 90-95 for the proteins of SEQ No. 1105 | 2d |
| SEQ ID No. 1417 | EVGEIR | 126-131 for the proteins of SEQ No. 1247 | 2d |
| SEQ ID No. 1418 | EVGEVR | 126-131 for the proteins of SEQ No. 1110, 1115, 1116, 1117, 1126, 1141, 1193, 1200, 1229, 1250, 1259, 1262; 117-122 for the protein of sequence SEQ ID No. 1106; 117-122 for the protein of sequence SEQ ID No. 1111; 117-122 for the protein of sequence SEQ ID No. 1112; 127-132 for the protein of sequence SEQ ID No. 1248 | OXA |
| SEQ ID No. 1419 | EVNGSK | 209-214 for the proteins of SEQ No. 1122, 1123, 1129, 1172, 1207, 1224, 1264 | 2df |
| SEQ ID No. 1420 | EWQENK | 24-29 for the proteins of SEQ No. 1136, 1208, 1234, 1243 | 2df |
| SEQ ID No. 1421 | EYELYLNVWK | 78-87 for the proteins of SEQ No. 1252 | 2de |
| SEQ ID No. 1422 | EYVPASTFK | 62-70 for the proteins of SEQ No. 1110, 1115, 1116, 1117, 1126, 1141, 1193, 1200, 1229, 1250, 1262; 53-61 for the protein of sequence SEQ ID No. 1106; 53-61 for the protein of sequence SEQ ID No. 1111; 53-61 for the protein of sequence SEQ ID No. 1112; 63-71 for the protein of sequence SEQ ID No. 1248 | OXA |
| SEQ ID No. 1423 | EYLPVSTFK | 62-70 for the proteins of SEQ No. 1259 | 2de |

-continued

| Peptide SEQ ID No. | Amino acid sequence | Position of the peptide in the OXA protein(s) | Clinical interest |
|---|---|---|---|
| SEQ ID No. 1424 | EYNTSGTFVFYDGK | 27-40 for the proteins of SEQ No. 1143 | 2d |
| SEQ ID No. 1425 | EYVPASTFK | 75-83 for the proteins of SEQ No. 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 76-84 for the protein of sequence SEQ ID No. 1122; 76-84 for the protein of sequence SEQ ID No. 1123; 74-82 for the protein of sequence SEQ ID No. 1124; 76-84 for the protein of sequence SEQ ID No. 1129; 74-82 for the protein of sequence SEQ ID No. 1132; 74-82 for the protein of sequence SEQ ID No. 1145; 76-84 for the protein of sequence SEQ ID No. 1172; 69-77 for the protein of sequence SEQ ID No. 1189; 69-77 for the protein of sequence SEQ ID No. 1190; 74-82 for the protein of sequence SEQ ID No. 1198; 74-82 for the protein of sequence SEQ ID No. 1199; 76-84 for the protein of sequence SEQ ID No. 1205; 76-84 for the protein of sequence SEQ ID No. 1207; 74-82 for the protein of sequence SEQ ID No. 1217; 74-82 for the protein of sequence SEQ ID No. 1218; 74-82 for the protein of sequence SEQ ID No. 1219; 74-82 for the protein of sequence SEQ ID No. 1220; 74-82 for the protein of sequence SEQ ID No. 1221; 74-82 for the protein of sequence SEQ ID No. 1222; 74-82 for the protein of sequence SEQ ID No. 1223; 76-84 for the protein of sequence SEQ ID No. 1224; 69-77 for the protein of sequence SEQ ID No. 1227; 74-82 for the protein of sequence SEQ ID No. 1244; 74-82 for the protein of sequence SEQ ID No. 1251; 76-84 for the protein of sequence SEQ ID No. 1264 | 2df |
| SEQ ID No. 1426 | FAAYVAGFGYGNGDISGEPGK | 120-140 for the proteins of SEQ No. 1256 | 2d |
| SEQ ID No. 1427 | FAPESTFK | 45-52 for the proteins of SEQ No. 1252 | 2de |
| SEQ ID No. 1428 | FAQYAK | 121-126 for the proteins of SEQ No. 1254, 1255, 1257, 1258 | 2d |
| SEQ ID No. 1429 | FDYGNK | 138-143 for the proteins of SEQ No. 1109 | 2de |
| SEQ ID No. 1430 | FDYGNR | 146-151 for the proteins of SEQ No. 1137; 125-130 for the protein of sequence SEQ ID No. 1105 | 2d |
| SEQ ID No. 1431 | FEDLYK | 232-237 for the proteins of SEQ No. 1143 | 2d |
| SEQ ID No. 1432 | FEDTFHISNQK | 27-37 for the proteins of SEQ No. 1224 | 2df |
| SEQ ID No. 1433 | FEDTFHTSNQQHEK | 27-40 for the proteins of SEQ No. 1205 | 2df |
| SEQ ID No. 1434 | FEYGNQDVSGDSGK | 133-146 for the proteins of SEQ No. 1107 | 2d |
| SEQ ID No. 1435 | FFSDFQAK | 34-41 for the proteins of SEQ No. 1133 | 2d |

-continued

| Peptide SEQ ID No. | Amino acid sequence | Position of the peptide in the OXA protein(s) | Clinical interest |
|---|---|---|---|
| SEQ ID No. 1436 | FFSDLQAEGAIVIADER | 34-50 for the proteins of SEQ No. 1131, 1242 | 2d |
| SEQ ID No. 1437 | FFSDLR | 34-39 for the proteins of SEQ No. 1127, 1130 | OXA |
| SEQ ID No. 1438 | FFSEFQAK | 34-41 for the proteins of SEQ No. 1108, 1114, 1125, 1128, 1173, 1201, 1239, 1246, 1249; 23-30 for the protein of sequence SEQ ID No. 1120 | OXA |
| SEQ ID No. 1439 | FGLEGQLR | 153-160 for the proteins of SEQ No. 1117 | 2de |
| SEQ ID No. 1440 | FILPIFSISILVSLSACSSIK | 4-24 for the proteins of SEQ No. 1122, 1123, 1129, 1172, 1207, 1264 | 2df |
| SEQ ID No. 1441 | FLALLFSAVVLVSLGHAQDK | 5-24 for the proteins of SEQ No. 1121 | 2d |
| SEQ ID No. 1442 | FLALLFSAVVLVSLGHAQEK | 5-24 for the proteins of SEQ No. 1113 | 2d |
| SEQ ID No. 1443 | FLESLYLNNLPASK | 169-182 for the proteins of SEQ No. 1247, 1263 | OXA |
| SEQ ID No. 1444 | FLLEGQLR | 153-160 for the proteins of SEQ No. 1200 | 2de |
| SEQ ID No. 1445 | FQQYVDR | 118-124 for the proteins of SEQ No. 1105 | 2d |
| SEQ ID No. 1446 | FSDYVQR | 131-137 for the proteins of SEQ No. 1109 | 2de |
| SEQ ID No. 1447 | FSTASTFK | 63-70 for the proteins of SEQ No. 1228 | 2df |
| SEQ ID No. 1448 | FSWDGK | 117-122 for the proteins of SEQ No. 1139 | 2df |
| SEQ ID No. 1449 | FSYGNQNISGGIDK | 139-152 for the proteins of SEQ No. 1110, 1115, 1116, 1117, 1126, 1141, 1193, 1200, 1259, 1262; 130-143 for the protein of sequence SEQ ID No. 1106; 130-143 for the protein of sequence SEQ ID No. 1111; 130-143 for the protein of sequence SEQ ID No. 1112; 140-153 for the protein of sequence SEQ ID No. 1248 | OXA |
| SEQ ID No. 1450 | FSYGNQNISGGTDK | 139-152 for the proteins of SEQ No. 1229 | 2de |
| SEQ ID No. 1451 | FSYGSQNISGGIDK | 139-152 for the proteins of SEQ No. 1250 | 2de |
| SEQ ID No. 1452 | FTEYVK | 126-131 for the proteins of SEQ No. 1107 | 2d |
| SEQ ID No. 1453 | FVAHK | 173-177 for the proteins of SEQ No. 1107 | 2d |
| SEQ ID No. 1454 | FVPASTYK | 62-69 for the proteins of SEQ No. 1138 | 2d |
| SEQ ID No. 1455 | FVYDLAQGQLPFK | 184-196 for the proteins of SEQ No. 1168, 1171, 1216 | 2df |
| SEQ ID No. 1456 | FVYDLAQGQLPFKPEVQQQVK | 184-204 for the proteins of SEQ No. 1168, 1171, 1216 | 2df |
| SEQ ID No. 1457 | FWLEDQLR | 153-160 for the proteins of SEQ No. 1116, 1193, 1229, 1250; 144-151 for the protein of sequence SEQ ID No. 1106; 144-151 for the protein of sequence SEQ ID No. 1111 | 2de |

-continued

| Peptide SEQ ID No. | Amino acid sequence | Position of the peptide in the OXA protein(s) | Clinical interest |
|---|---|---|---|
| SEQ ID No. 1458 | FWLEGPLK | 144-151 for the proteins of SEQ No. 1135 | 2d |
| SEQ ID No. 1459 | FWLEGQLR | 153-160 for the proteins of SEQ No. 1110, 1115, 1126, 1141, 1247, 1259, 1262, 1263; 144-151 for the protein of sequence SEQ ID No. 1112; 154-161 for the protein of sequence SEQ ID No. 1248 | OXA |
| SEQ ID No. 1460 | FYPASSFK | 53-60 for the proteins of SEQ No. 1135 | 2d |
| SEQ ID No. 1461 | FYPASTFK | 66-73 for the proteins of SEQ No. 1144, 1187, 1188, 1235 | 2d |
| SEQ ID No. 1462 | GACDK | 44-48 for the proteins of SEQ No. 1256 | 2d |
| SEQ ID No. 1463 | GAEVYFFAFNMDIDNENK | 229-246 for the proteins of SEQ No. 1141, 1248 | 2d |
| SEQ ID No. 1464 | GAIQVSAVPVFQQIAR | 110-125 for the proteins of SEQ No. 1110, 1115, 1116, 1117, 1126, 1141, 1193, 1200, 1229, 1247, 1250, 1259, 1262, 1263; 101-116 for the protein of sequence SEQ ID No. 1106; 101-116 for the protein of sequence SEQ ID No. 1112; 111-126 for the protein of sequence SEQ ID No. 1248 | OXA |
| SEQ ID No. 1465 | GAIQVSAVPVFQQITR | 101-116 for the proteins of SEQ No. 1111 | 2de |
| SEQ ID No. 1466 | GDYWIDGNLEISAHEQISFLR | 156-176 for the proteins of SEQ No. 1127, 1130 | OXA |
| SEQ ID No. 1467 | GDYWIDGNLK | 156-165 for the proteins of SEQ No. 1131 | 2d |
| SEQ ID No. 1468 | GELPVSEDALEMTK | 181-194 for the proteins of SEQ No. 1109 | 2de |
| SEQ ID No. 1469 | GEQPAGPAAR | 241-250 for the proteins of SEQ No. 1256; 252-261 for the protein of sequence SEQ ID No. 1109 | OXA |
| SEQ ID No. 1470 | GFAGHNQDQDLR | 103-114 for the proteins of SEQ No. 1108, 1125, 1128, 1173, 1201, 1239, 1246; 92-103 for the protein of sequence SEQ ID No. 1120 | OXA |
| SEQ ID No. 1471 | GIPSSVR | 254-260 for the proteins of SEQ No. 1147, 1148, 1149, 1150, 1151, 1152, 1153, 1155, 1156, 1157, 1158, 1159, 1160, 1161, 1162, 1163, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 248-254 for the protein of sequence SEQ ID No. 1189; 248-254 for the protein of sequence SEQ ID No. 1190 | 2df |
| SEQ ID No. 1472 | GISSSVR | 254-260 for the proteins of SEQ No. 1146 | 2df |
| SEQ ID No. 1473 | GLNGTFVVYDLK | 26-37 for the proteins of SEQ No. 1135 | 2d |
| SEQ ID No. 1474 | GMEIWNSNHTPK | 101-112 for the proteins of SEQ No. 1118, 1134; 86-97 for the protein of sequence SEQ ID No. 1119 | 2d |
| SEQ ID No. 1475 | GNQTLVFAR | 230-238 for the proteins of SEQ No. 1254 | 2d |

-continued

| Peptide SEQ ID No. | Amino acid sequence | Position of the peptide in the OXA protein(s) | Clinical interest |
|---|---|---|---|
| SEQ ID No. 1476 | GNYWIDGNLEISAHEQISFLR | 156-176 for the proteins of SEQ No. 1242 | OXA |
| SEQ ID No. 1477 | GPLEISAFEEAR | 164-175 for the proteins of SEQ No. 1137 | 2df |
| SEQ ID No. 1478 | GPLTITPIQEVK | 172-183 for the proteins of SEQ No. 1168, 1171, 1216 | 2df |
| SEQ ID No. 1479 | GSGWFVGWIVR | 219-229 for the proteins of SEQ No. 1254, 1255, 1257, 1258 | 2d |
| SEQ ID No. 1480 | GSLLLWDQK | 66-74 for the proteins of SEQ No. 1139 | 2df |
| SEQ ID No. 1481 | GTEVYFFAFNMDIDNENK | 229-246 for the proteins of SEQ No. 1115, 1116, 1117, 1126, 1200, 1229, 1262 | OXA |
| SEQ ID No. 1482 | GTEVYFFAFNMDIDNESK | 229-246 for the proteins of SEQ No. 1247, 1263 | OXA |
| SEQ ID No. 1483 | GTFVLYDVQR | 38-47 for the proteins of SEQ No. 1138 | 2d |
| SEQ ID No. 1484 | GTIVVADER | 42-50 for the proteins of SEQ No. 1108, 1114, 1125, 1128, 1133, 1173, 1201, 1239, 1246, 1249; 31-39 for the protein of sequence SEQ ID No. 1120 | OXA |
| SEQ ID No. 1485 | GTIVVLDAR | 63-71 for the proteins of SEQ No. 1140 | 2df |
| SEQ ID No. 1486 | GTIVVVDER | 42-50 for the proteins of SEQ No. 1113, 1121 | 2d |
| SEQ ID No. 1487 | GTLPFSAR | 200-207 for the proteins of SEQ No. 1140 | 2df |
| SEQ ID No. 1488 | GTPSSVR | 254-260 for the proteins of SEQ No. 1154 | 2df |
| SEQ ID No. 1489 | HALSSAFVLLGCIAASAHAK | 5-24 for the proteins of SEQ No. 1254, 1255, 1257, 1258 | 2d |
| SEQ ID No. 1490 | HIADSK | 234-239 for the proteins of SEQ No. 1252 | 2de |
| SEQ ID No. 1491 | HNGLTHAWLASSLK | 152-165 for the proteins of SEQ No. 1109 | 2de |
| SEQ ID No. 1492 | HNGLTQSWLMSSLTISPK | 147-164 for the proteins of SEQ No. 1107 | 2d |
| SEQ ID No. 1493 | HNGTDGAWIISSLR | 148-161 for the proteins of SEQ No. 1191 | 2d |
| SEQ ID No. 1494 | HTLSVFDQER | 54-63 for the proteins of SEQ No. 1131 | 2d |
| SEQ ID No. 1495 | HVTFASFR | 241-248 for the proteins of SEQ No. 1252 | 2de |
| SEQ ID No. 1496 | IAISLMGYDAGFLR | 57-70 for the proteins of SEQ No. 1254, 1255, 1257, 1258 | 2d |
| SEQ ID No. 1497 | IALSLMAFDAEIIDQK | 75-90 for the proteins of SEQ No. 1118, 1134; 60-75 for the protein of sequence SEQ ID No. 1119 | 2d |
| SEQ ID No. 1498 | IALSLMGFDSGILK | 53-66 for the proteins of SEQ No. 1252 | 2de |
| SEQ ID No. 1499 | IANALIGLENHK | 87-98 for the proteins of SEQ No. 1168, 1171, 1216 | 2df |

-continued

| Peptide SEQ ID No. | Amino acid sequence | Position of the peptide in the OXA protein(s) | Clinical interest |
|---|---|---|---|
| SEQ ID No. 1500 | IAWIVGFVYLK | 205-215 for the proteins of SEQ No. 1143 | 2d |
| SEQ ID No. 1501 | IDTFWLDNSLK | 141-151 for the proteins of SEQ No. 1143 | 2d |
| SEQ ID No. 1502 | IDYYNLDR | 41-48 for the proteins of SEQ No. 1135 | 2d |
| SEQ ID No. 1503 | IFNALIALDSGVIK | 62-75 for the proteins of SEQ No. 1143 | 2d |
| SEQ ID No. 1504 | IFNSLLALDSGALDNER | 95-111 for the proteins of SEQ No. 1140 | 2df |
| SEQ ID No. 1505 | IFNTLIGLENGIVK | 61-74 for the proteins of SEQ No. 1135 | 2d |
| SEQ ID No. 1506 | IGLDLMQK | 138-145 for the proteins of SEQ No. 1124, 1132, 1145, 1198, 1199, 1217, 1218, 1219, 1220, 1221, 1222, 1223, 1244, 1251 | 2df |
| SEQ ID No. 1507 | IGLEK | 131-135 for the proteins of SEQ No. 1235 | OXA |
| SEQ ID No. 1508 | IGLELMQQEVQR | 133-144 for the proteins of SEQ No. 1227 | 2df |
| SEQ ID No. 1509 | IGLELMSK | 139-146 for the proteins of SEQ No. 1147, 1148, 1149, 1151, 1153, 1156, 1157, 1158, 1159, 1160, 1161, 1162, 1166, 1167, 1169, 1170, 1175, 1177, 1178, 1179, 1180, 1181, 1182, 1183, 1184, 1185, 1186, 1194, 1195, 1196, 1197, 1209, 1210, 1211, 1212, 1213, 1214, 1215, 1225, 1226, 1230, 1231, 1232, 1236, 1237, 1238, 1240, 1241, 1245, 1253, 1260, 1266 | 2df |
| SEQ ID No. 1510 | IGLELMSNEVK | 139-149 for the proteins of SEQ No. 1146, 1150, 1152, 1154, 1155, 1163, 1164, 1165, 1174, 1176, 1192, 1202, 1203, 1204, 1206, 1233, 1261, 1265; 133-143 for the protein of sequence SEQ ID No. 1189; 133-143 for the protein of sequence SEQ ID No. 1190 | 2df |
| SEQ ID No. 1511 | IGLER | 126-130 for the proteins of SEQ No. 1138 | 2d |
| SEQ ID No. 1512 | IGLNK | 130-134 for the proteins of SEQ No. 1118, 1134; 115-119 for the protein of sequence SEQ ID No. 1119 | 2d |
| SEQ ID No. 1513 | IGLNLMQK | 140-147 for the proteins of SEQ No. 1224 | 2df |
| SEQ ID No. 1514 | IGPSLMQSELQR | 142-153 for the proteins of SEQ No. 1168, 1171, 1216 | 2df |
| SEQ ID No. 1515 | IGYGNMQIGTEVDQFWLK | 154-171 for the proteins of SEQ No. 1171, 1216 | 2df |
| SEQ ID No. 1516 | IGYGNMQMGTEVDQFWLK | 154-171 for the proteins of SEQ No. 1168 | 2df |
| SEQ ID No. 1517 | IINHNLPVK | 167-175 for the proteins of SEQ No. 1119; 182-190 for the protein of sequence SEQ ID No. 1118 | 2d |
| SEQ ID No. 1518 | IINHNLPVR | 182-190 for the proteins of SEQ No. 1134 | 2d |
| SEQ ID No. 1519 | ILFQQGTQQACAER | 41-54 for the proteins of SEQ No. 1191 | 2d |

-continued

| Peptide SEQ ID No. | Amino acid sequence | Position of the peptide in the OXA protein(s) | Clinical interest |
|---|---|---|---|
| SEQ ID No. 1520 | ILNNWFK | 20-26 for the proteins of SEQ No. 1143 | 2d |
| SEQ ID No. 1521 | ILNTLISLEEK | 71-81 for the proteins of SEQ No. 1228 | 2df |
| SEQ ID No. 1522 | ILSLVCLSISIGACAEHSMSR | 6-26 for the proteins of SEQ No. 1168, 1171, 1216 | 2df |
| SEQ ID No. 1523 | INESR | 219-223 for the proteins of SEQ No. 1107 | 2d |
| SEQ ID No. 1524 | INIVK | 255-259 for the proteins of SEQ No. 1187, 1188, 1235; 254-258 for the protein of sequence SEQ ID No. 1144 | 2d |
| SEQ ID No. 1525 | INLYGNALSR | 61-70 for the proteins of SEQ No. 1124, 1132, 1145, 1198, 1199, 1217, 1218, 1219, 1220, 1221, 1222, 1223, 1244, 1251 | 2df |
| SEQ ID No. 1526 | IPFSLNLEMK | 244-253 for the proteins of SEQ No. 1122, 1123, 1129, 1172, 1207, 1264 | 2df |
| SEQ ID No. 1527 | IPHTLFALDADAVR | 76-89 for the proteins of SEQ No. 1131 | 2d |
| SEQ ID No. 1528 | IPHTLFALDAGAAR | 76-89 for the proteins of SEQ No. 1114, 1249 | 2d |
| SEQ ID No. 1529 | IPHTLFALDAGAVR | 76-89 for the proteins of SEQ No. 1108, 1113, 1121, 1125, 1128, 1133, 1173, 1201, 1239, 1246; 65-78 for the protein of sequence SEQ ID No. 1120 | OXA |
| SEQ ID No. 1530 | IPLGK | 255-259 for the proteins of SEQ No. 1137 | 2df |
| SEQ ID No. 1531 | IPNAIIGLETGVIK | 71-84 for the proteins of SEQ No. 1110, 1116, 1117, 1126, 1141, 1200, 1229, 1250, 1262; 62-75 for the protein of sequence SEQ ID No. 1106; 62-75 for the protein of sequence SEQ ID No. 1111; 72-85 for the protein of sequence SEQ ID No. 1248 | OXA |
| SEQ ID No. 1532 | IPNALIGLETGAIK | 71-84 for the proteins of SEQ No. 1247, 1263 | OXA |
| SEQ ID No. 1533 | IPNSLIAFDTGAVR | 78-91 for the proteins of SEQ No. 1137 | 2df |
| SEQ ID No. 1534 | IPSAIIGLETGVIK | 71-84 for the proteins of SEQ No. 1115, 1193, 1259; 62-75 for the protein of sequence SEQ ID No. 1112 | 2de |
| SEQ ID No. 1535 | ISAFNQVK | 161-168 for the proteins of SEQ No. 1247 | 2d |
| SEQ ID No. 1536 | ISAHEQILFLR | 166-176 for the proteins of SEQ No. 1131 | 2d |
| SEQ ID No. 1537 | ISAMEQTR | 160-167 for the proteins of SEQ No. 1138 | 2d |
| SEQ ID No. 1538 | ISAMEQVK | 165-172 for the proteins of SEQ No. 1187, 1235; 152-159 for the protein of sequence SEQ ID No. 1135; 164-171 for the protein of sequence SEQ ID No. 1144 | 2d |
| SEQ ID No. 1539 | ISATEQVAFLR | 164-174 for the proteins of SEQ No. 1142 | 2df |
| SEQ ID No. 1540 | ISATQQIAFLR | 164-174 for the proteins of SEQ No. 1243 | 2df |

-continued

| Peptide SEQ ID No. | Amino acid sequence | Position of the peptide in the OXA protein(s) | Clinical interest |
|---|---|---|---|
| SEQ ID No. 1541 | ISAVNQVEFLESLFLNK | 161-177 for the proteins of SEQ No. 1115, 1116, 1117, 1126, 1141, 1200, 1229, 1262; 162-178 for the protein of sequence SEQ ID No. 1248 | OXA |
| SEQ ID No. 1542 | ISAVNQVEFLESLYLNK | 161-177 for the proteins of SEQ No. 1110, 1193, 1250, 1259; 152-168 for the protein of sequence SEQ ID No. 1106; 152-168 for the protein of sequence SEQ ID No. 1111; 152-168 for the protein of sequence SEQ ID No. 1112 | OXA |
| SEQ ID No. 1543 | ISAVNQVK | 161-168 for the proteins of SEQ No. 1263 | 2de |
| SEQ ID No. 1544 | ISPEEQIQFLR | 170-180 for the proteins of SEQ No. 1118, 1134; 155-165 for the protein of sequence SEQ ID No. 1119 | 2d |
| SEQ ID No. 1545 | ISPEEQVR | 166-173 for the proteins of SEQ No. 1109 | 2de |
| SEQ ID No. 1546 | ISPEGQVR | 155-162 for the proteins of SEQ No. 1256 | 2d |
| SEQ ID No. 1547 | ISPLEQLAFLR | 162-172 for the proteins of SEQ No. 1191 | 2d |
| SEQ ID No. 1548 | ITAFQQVDFLR | 188-198 for the proteins of SEQ No. 1139 | 2df |
| SEQ ID No. 1549 | ITLFLLFLNLVFGQDK | 4-19 for the proteins of SEQ No. 1143 | 2d |
| SEQ ID No. 1550 | ITPIQEVNFADDFANNR | 174-190 for the proteins of SEQ No. 1205 | 2df |
| SEQ ID No. 1551 | ITPIQEVNFADDLANNR | 174-190 for the proteins of SEQ No. 1224 | 2df |
| SEQ ID No. 1552 | ITPQQEAQFAYK | 173-184 for the proteins of SEQ No. 1146, 1147, 1148, 1149, 1150, 1151, 1152, 1153, 1154, 1155, 1156, 1157, 1158, 1159, 1160, 1161, 1162, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 167-178 for the protein of sequence SEQ ID No. 1189; 167-178 for the protein of sequence SEQ ID No. 1190 | 2df |
| SEQ ID No. 1553 | ITPQQEAQFTYK | 173-184 for the proteins of SEQ No. 1163 | 2df |
| SEQ ID No. 1554 | ITPVQEVNFADDLAHNR | 174-190 for the proteins of SEQ No. 1122, 1123, 1129, 1172, 1207, 1264 | 2df |
| SEQ ID No. 1555 | IVAFALK | 241-247 for the proteins of SEQ No. 1124, 1145 | 2df |
| SEQ ID No. 1556 | IVAFALNMEMR | 241-251 for the proteins of SEQ No. 1198, 1217, 1218, 1219, 1220, 1221, 1222, 1223, 1244, 1251; 242-252 for the protein of sequence SEQ ID No. 1132; 242-252 for the protein of sequence SEQ ID No. 1199 | 2df |
| SEQ ID No. 1557 | IVESTTLADGTVVHGK | 186-201 for the proteins of SEQ No. 1254, 1255, 1257, 1258 | 2d |
| SEQ ID No. 1558 | IYNSLIGLNEK | 74-84 for the proteins of SEQ No. 1144, 1187, 1188, 1235 | 2d |

-continued

| Peptide SEQ ID No. | Amino acid sequence | Position of the peptide in the OXA protein(s) | Clinical interest |
|---|---|---|---|
| SEQ ID No. 1559 | KPDIGWWVGWIER | 237-249 for the proteins of SEQ No. 1140 | 2df |
| SEQ ID No. 1560 | LACATNNLAR | 50-59 for the proteins of SEQ No. 1248 | 2d |
| SEQ ID No. 1561 | LAQGELPFPAPVQSTVR | 172-188 for the proteins of SEQ No. 1138 | 2d |
| SEQ ID No. 1562 | LAQNELPYPIEIQK | 177-190 for the proteins of SEQ No. 1187, 1188, 1235 | 2d |
| SEQ ID No. 1563 | LAQNELQYPIEIQK | 176-189 for the proteins of SEQ No. 1144 | 2d |
| SEQ ID No. 1564 | LDFGNK | 143-148 for the proteins of SEQ No. 1187, 1188, 1235; 142-147 for the protein of sequence SEQ ID No. 1144 | 2d |
| SEQ ID No. 1565 | LDGSLNR | 206-212 for the proteins of SEQ No. 1105 | 2d |
| SEQ ID No. 1566 | LEIGK | 244-248 for the proteins of SEQ No. 1107 | 2d |
| SEQ ID No. 1567 | LEILQQALAELGLYPK | 255-270 for the proteins of SEQ No. 1227 | 2df |
| SEQ ID No. 1568 | LENQEQVK | 173-180 for the proteins of SEQ No. 1135 | 2d |
| SEQ ID No. 1569 | LETQEEVEK | 195-203 for the proteins of SEQ No. 1122 | 2df |
| SEQ ID No. 1570 | LETQEEVK | 195-202 for the proteins of SEQ No. 1123, 1129, 1172, 1205, 1207, 1224, 1264 | 2df |
| SEQ ID No. 1571 | LFAAEGVK | 55-62 for the proteins of SEQ No. 1140 | 2df |
| SEQ ID No. 1572 | LFESAGVK | 58-65 for the proteins of SEQ No. 1139 | 2df |
| SEQ ID No. 1573 | LFGAAGVK | 30-37 for the proteins of SEQ No. 1138 | 2d |
| SEQ ID No. 1574 | LFPEWEK | 110-116 for the proteins of SEQ No. 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 104-110 for the protein of sequence SEQ ID No. 1189; 104-110 for the protein of sequence SEQ ID No. 1190 | 2df |
| SEQ ID No. 1575 | LGESR | 126-130 for the proteins of SEQ No. 1109 | 2de |
| SEQ ID No. 1576 | LGVDR | 121-125 for the proteins of SEQ No. 1107 | 2d |
| SEQ ID No. 1577 | LHVSER | 181-186 for the proteins of SEQ No. 1136, 1142, 1208, 1234, 1243 | 2df |
| SEQ ID No. 1578 | LHYGNAK | 131-137 for the proteins of SEQ No. 1143 | 2d |
| SEQ ID No. 1579 | LLNLLSQSK | 160-168 for the proteins of SEQ No. 1135 | 2d |

-continued

| Peptide SEQ ID No. | Amino acid sequence | Position of the peptide in the OXA protein(s) | Clinical interest |
|---|---|---|---|
| SEQ ID No. 1580 | LLQDER | 243-248 for the proteins of SEQ No. 1191 | 2d |
| SEQ ID No. 1581 | LLVQDGDCGR | 38-47 for the proteins of SEQ No. 1254, 1255, 1257, 1258 | 2d |
| SEQ ID No. 1582 | LNEVGYGNR | 160-168 for the proteins of SEQ No. 1140 | 2df |
| SEQ ID No. 1583 | LNYGNADPSTK | 144-154 for the proteins of SEQ No. 1113, 1121 | 2d |
| SEQ ID No. 1584 | LNYGNK | 130-135 for the proteins of SEQ No. 1135 | 2d |
| SEQ ID No. 1585 | LPASK | 178-182 for the proteins of SEQ No. 1247, 1263; 172-176 for the protein of sequence SEQ ID No. 1256 | 2d |
| SEQ ID No. 1586 | LPHTLFALDADAVR | 76-89 for the proteins of SEQ No. 1127, 1130 | OXA |
| SEQ ID No. 1587 | LPHTLFALDAGAVR | 76-89 for the proteins of SEQ No. 1242 | OXA |
| SEQ ID No. 1588 | LPLAIMGFDSGILQSPK | 62-78 for the proteins of SEQ No. 1107 | 2d |
| SEQ ID No. 1589 | LPLAIMGYDADILLDATTPR | 69-88 for the proteins of SEQ No. 1109 | 2de |
| SEQ ID No. 1590 | LPSSLIALETGAVR | 98-111 for the proteins of SEQ No. 1139 | 2df |
| SEQ ID No. 1591 | LPVSAQTLQYTANILK | 170-185 for the proteins of SEQ No. 1105 | 2d |
| SEQ ID No. 1592 | LPVSER | 205-210 for the proteins of SEQ No. 1139 | 2df |
| SEQ ID No. 1593 | LPVSPTAVDMTER | 173-185 for the proteins of SEQ No. 1254, 1255, 1257, 1258 | 2d |
| SEQ ID No. 1594 | LSASK | 178-182 for the proteins of SEQ No. 1110, 1115, 1116, 1117, 1126, 1141, 1193, 1200, 1229, 1250, 1259, 1262; 169-173 for the protein of sequence SEQ ID No. 1106; 169-173 for the protein of sequence SEQ ID No. 1111; 169-173 for the protein of sequence SEQ ID No. 1112; 179-183 for the protein of sequence SEQ ID No. 1248 | OXA |
| SEQ ID No. 1595 | LSAVPIYQEVAR | 121-132 for the proteins of SEQ No. 1137 | 2df |
| SEQ ID No. 1596 | LSAVPVYQELAR | 127-138 for the proteins of SEQ No. 1122, 1123, 1129, 1172, 1205, 1207, 1264; 125-136 for the protein of sequence SEQ ID No. 1124; 125-136 for the protein of sequence SEQ ID No. 1132; 125-136 for the protein of sequence SEQ ID No. 1145; 125-136 for the protein of sequence SEQ ID No. 1198; 125-136 for the protein of sequence SEQ ID No. 1199; 125-136 for the protein of sequence SEQ ID No. 1217; 125-136 for the protein of sequence SEQ ID No. 1218; 125-136 for the protein of sequence SEQ ID No. 1219; 125-136 for the protein of sequence SEQ ID No. 1220; 125-136 for the protein of sequence SEQ ID No. 1221; 125-136 for the protein of sequence SEQ ID No. 1222; 125-136 for the protein of sequence SEQ ID No. 1223; 125-136 for the protein of sequence SEQ ID No. 1244; 125-136 for the protein of sequence SEQ ID No. 1251 | 2df |

-continued

| Peptide SEQ ID No. | Amino acid sequence | Position of the peptide in the OXA protein(s) | Clinical interest |
|---|---|---|---|
| SEQ ID No. 1597 | LSCTLVIDEASGDLLHR | 37-53 for the proteins of SEQ No. 1109 | 2de |
| SEQ ID No. 1598 | LSLQHGWFIGWIEK | 211-224 for the proteins of SEQ No. 1252 | 2de |
| SEQ ID No. 1599 | LSQNSLPFSQEAMNSVK | 164-180 for the proteins of SEQ No. 1143 | 2d |
| SEQ ID No. 1600 | LSVNPK | 168-173 for the proteins of SEQ No. 1252 | 2de |
| SEQ ID No. 1601 | LTQDER | 239-244 for the proteins of SEQ No. 1254, 1255, 1257, 1258 | 2d |
| SEQ ID No. 1602 | LTVGAR | 245-250 for the proteins of SEQ No. 1109 | 2de |
| SEQ ID No. 1603 | LYGFALNIDMPGGEADIGK | 228-246 for the proteins of SEQ No. 1138 | 2d |
| SEQ ID No. 1604 | LYHNELPFR | 178-186 for the proteins of SEQ No. 1114, 1249 | 2d |
| SEQ ID No. 1605 | LYHNK | 176-180 for the proteins of SEQ No. 1136, 1142, 1208, 1234, 1243 | 2df |
| SEQ ID No. 1606 | LYQNDLPFR | 178-186 for the proteins of SEQ No. 1133 | 2d |
| SEQ ID No. 1607 | MDDLFK | 243-248 for the proteins of SEQ No. 1108, 1114, 1125, 1128, 1133, 1173, 1201, 1239, 1246, 1249; 232-237 for the protein of sequence SEQ ID No. 1120 | OXA |
| SEQ ID No. 1608 | MEDLHK | 243-248 for the proteins of SEQ No. 1113, 1121 | 2d |
| SEQ ID No. 1609 | MLIALIGLENHK | 85-96 for the proteins of SEQ No. 1264 | 2df |
| SEQ ID No. 1610 | MLLIEQQGDAALYAK | 198-212 for the proteins of SEQ No. 1137 | 2df |
| SEQ ID No. 1611 | MLLIK | 204-208 for the proteins of SEQ No. 1122, 1123, 1129, 1172, 1205, 1207, 1224, 1264 | 2df |
| SEQ ID No. 1612 | MLNALIGLEHHK | 84-95 for the proteins of SEQ No. 1146, 1147, 1148, 1149, 1150, 1151, 1152, 1153, 1154, 1155, 1156, 1157, 1158, 1159, 1160, 1161, 1162, 1163, 1164, 1166, 1167, 1169, 1170, 1174, 1175, 1176, 1177, 1178, 1179, 1180, 1181, 1182, 1183, 1184, 1185, 1186, 1192, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1245, 1253, 1260, 1261, 1265, 1266; 78-89 for the protein of sequence SEQ ID No. 1189; 78-89 for the protein of sequence SEQ ID No. 1190 | 2df |
| SEQ ID No. 1613 | MLNALIGLENHK | 85-96 for the proteins of SEQ No. 1122, 1123, 1129, 1172, 1205, 1207, 1224 | 2df |
| SEQ ID No. 1614 | MLNALIGLENQK | 83-94 for the proteins of SEQ No. 1124, 1132, 1145, 1198, 1199, 1217, 1218, 1219, 1220, 1221, 1222, 1223, 1244, 1251 | 2df |
| SEQ ID No. 1615 | MLNALIGLEYHK | 84-95 for the proteins of SEQ No. 1241 | 2df |
| SEQ ID No. 1616 | MLNALIGLQHGK | 78-89 for the proteins of SEQ No. 1227 | 2df |

-continued

| Peptide SEQ ID No. | Amino acid sequence | Position of the peptide in the OXA protein(s) | Clinical interest |
|---|---|---|---|
| SEQ ID No. 1617 | MLNALISLEHHK | 84-95 for the proteins of SEQ No. 1165 | 2df |
| SEQ ID No. 1618 | MQAYVDAFDYGNR | 139-151 for the proteins of SEQ No. 1137 | 2df |
| SEQ ID No. 1619 | MQEGLNK | 123-129 for the proteins of SEQ No. 1135 | 2d |
| SEQ ID No. 1620 | MSPASTYK | 87-94 for the proteins of SEQ No. 1140 | 2df |
| SEQ ID No. 1621 | MTAGGK | 234-239 for the proteins of SEQ No. 1256 | 2d |
| SEQ ID No. 1622 | MVSGK | 165-169 for the proteins of SEQ No. 1105 | 2d |
| SEQ ID No. 1623 | NEHDPVLPYR | 71-80 for the proteins of SEQ No. 1254, 1255, 1257, 1258 | 2d |
| SEQ ID No. 1624 | NEHQIFK | 86-92 for the proteins of SEQ No. 1248; 85-91 for the protein of sequence SEQ ID No. 1141 | 2d |
| SEQ ID No. 1625 | NEHQVFK | 85-91 for the proteins of SEQ No. 1110, 1115, 1116, 1117, 1126, 1193, 1200, 1229, 1250, 1259, 1262; 76-82 for the protein of sequence SEQ ID No. 1106; 76-82 for the protein of sequence SEQ ID No. 1111; 76-82 for the protein of sequence SEQ ID No. 1112 | OXA |
| SEQ ID No. 1626 | NEITYK | 262-267 for the proteins of SEQ No. 1122, 1123, 1129, 1172, 1205, 1207, 1224, 1264 | 2df |
| SEQ ID No. 1627 | NELLMK | 260-265 for the proteins of SEQ No. 1124, 1145, 1198, 1217, 1218, 1220, 1221, 1222, 1223, 1244, 1251; 261-266 for the protein of sequence SEQ ID No. 1132; 261-266 for the protein of sequence SEQ ID No. 1199 | 2df |
| SEQ ID No. 1628 | NELMMK | 260-265 for the proteins of SEQ No. 1219 | 2df |
| SEQ ID No. 1629 | NELPFR | 181-186 for the proteins of SEQ No. 1108, 1113, 1114, 1121, 1125, 1128, 1173, 1201, 1239, 1246, 1249; 170-175 for the protein of sequence SEQ ID No. 1120 | OXA |
| SEQ ID No. 1630 | NFILIFIFVILISCK | 5-19 for the proteins of SEQ No. 1144, 1187, 1235 | 2d |
| SEQ ID No. 1631 | NFILIFIFVILTSCK | 5-19 for the proteins of SEQ No. 1188 | 2d |
| SEQ ID No. 1632 | NISSYGNNLVR | 62-72 for the proteins of SEQ No. 1224 | 2df |
| SEQ ID No. 1633 | NISTYGNNLTR | 62-72 for the proteins of SEQ No. 1205 | 2df |
| SEQ ID No. 1634 | NLFNEVHTTGVLVIR | 43-57 for the proteins of SEQ No. 1170 | 2df |
| SEQ ID No. 1635 | NLSTYGNALAR | 62-72 for the proteins of SEQ No. 1122, 1123, 1129, 1172, 1207, 1264 | 2df |
| SEQ ID No. 1636 | NMENLELFGK | 187-196 for the proteins of SEQ No. 1143 | 2d |
| SEQ ID No. 1637 | NMLLLEENNGYK | 201-212 for the proteins of SEQ No. 1198 | 2df |
| SEQ ID No. 1638 | NMLLLEESNGYK | 201-212 for the proteins of SEQ No. 1124, 1132, 1145, 1199, 1217, 1218, 1219, 1220, 1221, 1223, 1244, 1251 | 2df |

-continued

| Peptide SEQ ID No. | Amino acid sequence | Position of the peptide in the OXA protein(s) | Clinical interest |
|---|---|---|---|
| SEQ ID No. 1639 | NMLLLEK | 201-207 for the proteins of SEQ No. 1222 | 2df |
| SEQ ID No. 1640 | NMTLGDAMK | 117-125 for the proteins of SEQ No. 1146, 1150, 1151, 1154, 1155, 1160, 1163, 1164, 1174, 1177, 1180, 1182, 1192, 1203, 1204, 1206, 1233, 1261; 111-119 for the protein of sequence SEQ ID No. 1189; 111-119 for the protein of sequence SEQ ID No. 1190 | 2df |
| SEQ ID No. 1641 | NNGLTEAWLESSLK | 156-169 for the proteins of SEQ No. 1118, 1134; 141-154 for the protein of sequence SEQ ID No. 1119 | 2d |
| SEQ ID No. 1642 | NQLPFK | 181-186 for the proteins of SEQ No. 1131 | 2d |
| SEQ ID No. 1643 | NQLPFQVEHQR | 181-191 for the proteins of SEQ No. 1127, 1130, 1242 | OXA |
| SEQ ID No. 1644 | NSAIENTIDNMYLQDLENSTK | 191-211 for the proteins of SEQ No. 1134 | 2d |
| SEQ ID No. 1645 | NSAIENTIENMYLQDLDNSTK | 191-211 for the proteins of SEQ No. 1118 | 2d |
| SEQ ID No. 1646 | NSAIENTIENMYLQDLENSTK | 176-196 for the proteins of SEQ No. 1119 | 2d |
| SEQ ID No. 1647 | NSAVWVYELFAK | 119-130 for the proteins of SEQ No. 1127, 1130, 1242 | OXA |
| SEQ ID No. 1648 | NSQVPAYK | 118-125 for the proteins of SEQ No. 1187, 1188, 1235; 117-124 for the protein of sequence SEQ ID No. 1144 | 2d |
| SEQ ID No. 1649 | NSTVWIYELFAK | 119-130 for the proteins of SEQ No. 1114, 1249 | 2d |
| SEQ ID No. 1650 | NSTVWVYELFAK | 119-130 for the proteins of SEQ No. 1108, 1125, 1128, 1131, 1133, 1173, 1201, 1239, 1246; 108-119 for the protein of sequence SEQ ID No. 1120 | OXA |
| SEQ ID No. 1651 | NSTVWVYQLFAK | 119-130 for the proteins of SEQ No. 1113, 1121 | 2d |
| SEQ ID No. 1652 | NTSGALVIQTDK | 48-59 for the proteins of SEQ No. 1218 | 2df |
| SEQ ID No. 1653 | NTSGVLVIQTDK | 48-59 for the proteins of SEQ No. 1124, 1132, 1145, 1198, 1199, 1217, 1219, 1220, 1221, 1222, 1223, 1244, 1251 | 2df |
| SEQ ID No. 1654 | NVDEMFYYYDGSK | 75-87 for the proteins of SEQ No. 1135 | 2d |
| SEQ ID No. 1655 | NWILR | 204-208 for the proteins of SEQ No. 1108, 1114, 1125, 1127, 1128, 1130, 1133, 1173, 1201, 1239, 1242, 1246, 1249; 193-197 for the protein of sequence SEQ ID No. 1120 | OXA |
| SEQ ID No. 1656 | NWNAAMDLR | 125-133 for the proteins of SEQ No. 1140 | 2df |
| SEQ ID No. 1657 | NYVDAFHYGNQDISGDK | 118-134 for the proteins of SEQ No. 1252 | 2de |
| SEQ ID No. 1658 | QADHAILVFDQAR | 51-63 for the proteins of SEQ No. 1133 | 2d |
| SEQ ID No. 1659 | QAEHALLVFGQER | 51-63 for the proteins of SEQ No. 1127, 1130, 1242 | OXA |

-continued

| Peptide SEQ ID No. | Amino acid sequence | Position of the peptide in the OXA protein(s) | Clinical interest |
|---|---|---|---|
| SEQ ID No. 1660 | QAITK | 251-255 for the proteins of SEQ No. 1136, 1142, 1208, 1243; 247-251 for the protein of sequence SEQ ID No. 1234 | 2df |
| SEQ ID No. 1661 | QAMLTEANSDYIIR | 193-206 for the proteins of SEQ No. 1142 | 2df |
| SEQ ID No. 1662 | QEVQFVSALAR | 171-181 for the proteins of SEQ No. 1227 | 2df |
| SEQ ID No. 1663 | QFASIK | 243-248 for the proteins of SEQ No. 1105 | 2d |
| SEQ ID No. 1664 | QGMPGSIR | 254-261 for the proteins of SEQ No. 1205 | 2df |
| SEQ ID No. 1665 | QGMSGSIR | 254-261 for the proteins of SEQ No. 1224 | 2df |
| SEQ ID No. 1666 | QGQTQQSYGNDLAR | 58-71 for the proteins of SEQ No. 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1169, 1170, 1174, 1175, 1176, 1177, 1178, 1179, 1180, 1181, 1182, 1183, 1184, 1185, 1186, 1194, 1195, 1196, 1197, 1202, 1203, 1204, 1206, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 52-65 for the protein of sequence SEQ ID No. 1189; 52-65 for the protein of sequence SEQ ID No. 1190 | 2df |
| SEQ ID No. 1667 | QIDYGNADPSTIK | 143-155 for the proteins of SEQ No. 1127, 1130, 1242 | OXA |
| SEQ ID No. 1668 | QIDYGNVDPSTIK | 143-155 for the proteins of SEQ No. 1131 | 2d |
| SEQ ID No. 1669 | QIGEAR | 129-134 for the proteins of SEQ No. 1136, 1208, 1234, 1243 | 2df |
| SEQ ID No. 1670 | QIGQAR | 129-134 for the proteins of SEQ No. 1142 | 2df |
| SEQ ID No. 1671 | QIMLIEQTPAFTLR | 190-203 for the proteins of SEQ No. 1228 | 2df |
| SEQ ID No. 1672 | QLGSAIDQFWLR | 152-163 for the proteins of SEQ No. 1137 | 2df |
| SEQ ID No. 1673 | QLHDNK | 199-204 for the proteins of SEQ No. 1139 | 2df |
| SEQ ID No. 1674 | QLIFVHTVVQK | 229-239 for the proteins of SEQ No. 1105 | 2d |
| SEQ ID No. 1675 | QLIFVHTVVQKPGK | 229-242 for the proteins of SEQ No. 1105 | 2d |
| SEQ ID No. 1676 | QLPVK | 178-182 for the proteins of SEQ No. 1191; 184-188 for the protein of sequence SEQ ID No. 1137 | OXA |
| SEQ ID No. 1677 | QLPVKPR | 184-190 for the proteins of SEQ No. 1137 | 2df |
| SEQ ID No. 1678 | QLSLDVLDK | 265-273 for the proteins of SEQ No. 1168, 1171, 1216 | 2df |
| SEQ ID No. 1679 | QLVYAR | 237-242 for the proteins of SEQ No. 1191 | 2d |
| SEQ ID No. 1680 | QMMLTEASTDYIIR | 217-230 for the proteins of SEQ No. 1139 | 2df |

-continued

| Peptide SEQ ID No. | Amino acid sequence | Position of the peptide in the OXA protein(s) | Clinical interest |
|---|---|---|---|
| SEQ ID No. 1681 | QMSIVEATPDYVLHGK | 214-229 for the proteins of SEQ No. 1140 | 2df |
| SEQ ID No. 1682 | QPTDPAR | 99-105 for the proteins of SEQ No. 1191 | 2d |
| SEQ ID No. 1683 | QPTDPTR | 93-99 for the proteins of SEQ No. 1254, 1255, 1257, 1258 | 2d |
| SEQ ID No. 1684 | QPVSAGIR | 246-253 for the proteins of SEQ No. 1254, 1255, 1257, 1258 | 2d |
| SEQ ID No. 1685 | QQLVK | 275-279 for the proteins of SEQ No. 1139 | 2df |
| SEQ ID No. 1686 | QTLVFAR | 232-238 for the proteins of SEQ No. 1254, 1255, 1257, 1258 | 2d |
| SEQ ID No. 1687 | QVGAEK | 126-131 for the proteins of SEQ No. 1228 | 2df |
| SEQ ID No. 1688 | QVVFAR | 238-243 for the proteins of SEQ No. 1107 | 2d |
| SEQ ID No. 1689 | SADEVLPYGGK | 84-94 for the proteins of SEQ No. 1138 | 2d |
| SEQ ID No. 1690 | SADEVLPYGGKPQR | 84-97 for the proteins of SEQ No. 1138 | 2d |
| SEQ ID No. 1691 | SCATNDLAR | 50-58 for the proteins of SEQ No. 1110, 1193, 1250, 1259; 41-49 for the protein of sequence SEQ ID No. 1106; 41-49 for the protein of sequence SEQ ID No. 1111; 41-49 for the protein of sequence SEQ ID No. 1112 | OXA |
| SEQ ID No. 1692 | SCATNNLAR | 50-58 for the proteins of SEQ No. 1115, 1116, 1117, 1126, 1141, 1200, 1229, 1262 | OXA |
| SEQ ID No. 1693 | SDIPGGSK | 251-258 for the proteins of SEQ No. 1107 | 2d |
| SEQ ID No. 1694 | SDWGK | 29-33 for the proteins of SEQ No. 1133 | 2d |
| SEQ ID No. 1695 | SEDNFHISSQQHEK | 27-40 for the proteins of SEQ No. 1122, 1123, 1129, 1172, 1207, 1264 | 2df |
| SEQ ID No. 1696 | SEMPASIR | 252-259 for the proteins of SEQ No. 1124, 1145, 1198, 1217, 1218, 1219, 1220, 1221, 1222, 1244, 1251; 253-260 for the protein of sequence SEQ ID No. 1132; 253-260 for the protein of sequence SEQ ID No. 1199 | 2df |
| SEQ ID No. 1697 | SEMPASTR | 252-259 for the proteins of SEQ No. 1223 | 2df |
| SEQ ID No. 1698 | SFAAHNQDQDLR | 103-114 for the proteins of SEQ No. 1114, 1249 | 2d |
| SEQ ID No. 1699 | SFAGHNK | 103-109 for the proteins of SEQ No. 1133 | 2d |
| SEQ ID No. 1700 | SFAGHNQDQDLR | 103-114 for the proteins of SEQ No. 1127, 1130, 1131, 1242 | 2d |
| SEQ ID No. 1701 | SFAGHNQDQNLR | 103-114 for the proteins of SEQ No. 1113, 1121 | 2d |
| SEQ ID No. 1702 | SFLESWAK | 100-107 for the proteins of SEQ No. 1144 | 2d |

-continued

| Peptide SEQ ID No. | Amino acid sequence | Position of the peptide in the OXA protein(s) | Clinical interest |
|---|---|---|---|
| SEQ ID No. 1703 | SFTAWEK | 109-115 for the proteins of SEQ No. 1124, 1132, 1145, 1199, 1217, 1218, 1219, 1220, 1221, 1222, 1223, 1244, 1251; 104-110 for the protein of sequence SEQ ID No. 1227 | 2df |
| SEQ ID No. 1704 | SFTTWEK | 109-115 for the proteins of SEQ No. 1198 | 2df |
| SEQ ID No. 1705 | SGSGWLR | 207-213 for the proteins of SEQ No. 1107 | 2d |
| SEQ ID No. 1706 | SGWGMAVDPQVGWYVGFVEK | 221-240 for the proteins of SEQ No. 1168, 1171, 1216 | 2df |
| SEQ ID No. 1707 | SGWGMDVSPQVGWLTGWVEK | 219-238 for the proteins of SEQ No. 1224 | 2df |
| SEQ ID No. 1708 | SGWGMDVTPQVGWLTGWVEK | 219-238 for the proteins of SEQ No. 1205 | 2df |
| SEQ ID No. 1709 | SIHPASTFK | 69-77 for the proteins of SEQ No. 1137 | 2df |
| SEQ ID No. 1710 | SIPTK | 252-256 for the proteins of SEQ No. 1110, 1115, 1116, 1117, 1126, 1141, 1193, 1200, 1229, 1248, 1250, 1259, 1262, 1263; 243-247 for the protein of sequence SEQ ID No. 1106; 243-247 for the protein of sequence SEQ ID No. 1111; 243-247 for the protein of sequence SEQ ID No. 1112 | OXA |
| SEQ ID No. 1711 | SISTK | 252-256 for the proteins of SEQ No. 1247 | 2d |
| SEQ ID No. 1712 | SLGLSNNLSR | 76-85 for the proteins of SEQ No. 1139 | 2df |
| SEQ ID No. 1713 | SLSMSGK | 4-10 for the proteins of SEQ No. 1109 | 2de |
| SEQ ID No. 1714 | SMLFIEEK | 202-209 for the proteins of SEQ No. 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1169, 1174, 1175, 1176, 1177, 1178, 1179, 1180, 1182, 1183, 1184, 1185, 1186, 1192, 1194, 1195, 1196, 1197, 1202, 1203, 1204, 1209, 1210, 1211, 1212, 1213, 1214, 1215, 1225, 1226, 1230, 1231, 1232, 1233, 1236, 1237, 1238, 1240, 1241, 1245, 1253, 1260, 1261, 1265, 1266; 196-203 for the protein of sequence SEQ ID No. 1189; 196-203 for the protein of sequence SEQ ID No. 1190 | 2df |
| SEQ ID No. 1715 | SNGEK | 239-243 for the proteins of SEQ No. 1205, 1224 | 2df |
| SEQ ID No. 1716 | SNGLTHSWLGSSLK | 141-154 for the proteins of SEQ No. 1256 | 2d |
| SEQ ID No. 1717 | SNGYK | 208-212 for the proteins of SEQ No. 1124, 1132, 1145, 1199, 1217, 1218, 1219, 1220, 1221, 1222, 1223, 1244, 1251 | 2df |
| SEQ ID No. 1718 | SPTWELK | 79-85 for the proteins of SEQ No. 1107 | 2d |
| SEQ ID No. 1719 | SPTWELKPEYNPSPR | 79-93 for the proteins of SEQ No. 1107 | 2d |
| SEQ ID No. 1720 | SQDIVR | 208-213 for the proteins of SEQ No. 1140 | 2df |
| SEQ ID No. 1721 | SQQKPTDPTIWLK | 100-112 for the proteins of SEQ No. 1109 | 2de |

-continued

| Peptide SEQ ID No. | Amino acid sequence | Position of the peptide in the OXA protein(s) | Clinical interest |
|---|---|---|---|
| SEQ ID No. 1722 | SQVGWLTGWVEQPDGK | 225-240 for the proteins of SEQ No. 1244 | 2df |
| SEQ ID No. 1723 | SSSNSCTTNNAAR | 46-58 for the proteins of SEQ No. 1247 | 2d |
| SEQ ID No. 1724 | SSSNSCTTNNATR | 46-58 for the proteins of SEQ No. 1263 | 2de |
| SEQ ID No. 1725 | SVYGELR | 139-145 for the proteins of SEQ No. 1228 | 2df |
| SEQ ID No. 1726 | SWILR | 204-208 for the proteins of SEQ No. 1131 | 2d |
| SEQ ID No. 1727 | SYFDEAQTQGVIIIK | 44-58 for the proteins of SEQ No. 1122, 1123, 1129, 1172, 1205, 1207, 1224, 1264 | 2df |
| SEQ ID No. 1728 | SYLEK | 139-143 for the proteins of SEQ No. 1113, 1121 | 2d |
| SEQ ID No. 1729 | SYPMWEK | 111-117 for the proteins of SEQ No. 1205, 1224 | 2df |
| SEQ ID No. 1730 | TAYIPASTFK | 61-70 for the proteins of SEQ No. 1247, 1263; 77-86 for the protein of sequence SEQ ID No. 1168; 77-86 for the protein of sequence SEQ ID No. 1171; 77-86 for the protein of sequence SEQ ID No. 1216 | 2df |
| SEQ ID No. 1731 | TDDLFK | 243-248 for the proteins of SEQ No. 1127, 1130, 1131, 1242 | 2d |
| SEQ ID No. 1732 | TDINEIFK | 95-102 for the proteins of SEQ No. 1132, 1145, 1198, 1199, 1217, 1218, 1219, 1220, 1221, 1222, 1223, 1244, 1251 | 2df |
| SEQ ID No. 1733 | TFIHNDPR | 51-58 for the proteins of SEQ No. 1228 | 2df |
| SEQ ID No. 1734 | TGAGFTANR | 216-224 for the proteins of SEQ No. 1118, 1134; 201-209 for the protein of sequence SEQ ID No. 1119 | 2d |
| SEQ ID No. 1735 | TGFNDGQK | 197-204 for the proteins of SEQ No. 1143 | 2d |
| SEQ ID No. 1736 | TGLADSK | 210-216 for the proteins of SEQ No. 1187, 1188; 209-215 for the protein of sequence SEQ ID No. 1144 | 2d |
| SEQ ID No. 1737 | TGLDLMQK | 140-147 for the proteins of SEQ No. 1205 | 2df |
| SEQ ID No. 1738 | TGLELMQK | 140-147 for the proteins of SEQ No. 1122, 1123, 1129, 1172, 1207, 1264 | 2df |
| SEQ ID No. 1739 | TGMGYPK | 198-204 for the proteins of SEQ No. 1105 | 2d |
| SEQ ID No. 1740 | TGNGR | 197-201 for the proteins of SEQ No. 1252 | 2de |
| SEQ ID No. 1741 | TGTGSFIDAR | 200-209 for the proteins of SEQ No. 1256 | 2d |
| SEQ ID No. 1742 | TGTGSLSDAK | 211-220 for the proteins of SEQ No. 1109 | 2de |
| SEQ ID No. 1743 | TGVATEYQPEIGWWAGWVER | 213-232 for the proteins of SEQ No. 1137 | 2df |
| SEQ ID No. 1744 | TGVSYPLLADGTR | 202-214 for the proteins of SEQ No. 1254, 1255, 1257, 1258 | 2d |

-continued

| Peptide SEQ ID No. | Amino acid sequence | Position of the peptide in the OXA protein(s) | Clinical interest |
|---|---|---|---|
| SEQ ID No. 1745 | TGWAAMDIK | 217-225 for the proteins of SEQ No. 1132, 1199 | 2df |
| SEQ ID No. 1746 | TGWAMDIK | 217-224 for the proteins of SEQ No. 1124, 1145, 1198, 1218, 1219, 1220, 1221, 1222, 1223, 1244, 1251 | 2df |
| SEQ ID No. 1747 | TGWAMDVK | 217-224 for the proteins of SEQ No. 1217 | 2df |
| SEQ ID No. 1748 | TGWATR | 206-211 for the proteins of SEQ No. 1228 | 2df |
| SEQ ID No. 1749 | TGWCFDCTPELGWWVGWVK | 205-223 for the proteins of SEQ No. 1138 | 2d |
| SEQ ID No. 1750 | TGWEGR | 211-216 for the proteins of SEQ No. 1108, 1114, 1125, 1127, 1128, 1130, 1131, 1173, 1201, 1239, 1242, 1246, 1249; 200-205 for the protein of sequence SEQ ID No. 1120 | OXA |
| SEQ ID No. 1751 | TGWFVDK | 230-236 for the proteins of SEQ No. 1140 | 2df |
| SEQ ID No. 1752 | TGYDTK | 209-214 for the proteins of SEQ No. 1234 | 2df |
| SEQ ID No. 1753 | TGYGVR | 233-238 for the proteins of SEQ No. 1139 | 2df |
| SEQ ID No. 1754 | TGYSAR | 209-214 for the proteins of SEQ No. 1208 | 2df |
| SEQ ID No. 1755 | TGYSTR | 209-214 for the proteins of SEQ No. 1136, 1142, 1243 | 2df |
| SEQ ID No. 1756 | THESSNWGK | 25-33 for the proteins of SEQ No. 1113, 1121 | 2d |
| SEQ ID No. 1757 | TICTAIADAGTGK | 25-37 for the proteins of SEQ No. 1254, 1255, 1257, 1258 | 2d |
| SEQ ID No. 1758 | TIGGAPDAYWVDDSLQISAR | 169-188 for the proteins of SEQ No. 1140 | 2df |
| SEQ ID No. 1759 | TLPFSASSYETLR | 177-189 for the proteins of SEQ No. 1228 | 2df |
| SEQ ID No. 1760 | TLPFSLK | 189-195 for the proteins of SEQ No. 1157, 1161, 1169 | 2df |
| SEQ ID No. 1761 | TLPFSPK | 189-195 for the proteins of SEQ No. 1147, 1153, 1170, 1181, 1186, 1197, 1203, 1225, 1240, 1241, 1253 | 2df |
| SEQ ID No. 1762 | TLPFSQEVQDEVQSILFIEEK | 189-209 for the proteins of SEQ No. 1206 | 2df |
| SEQ ID No. 1763 | TLPFSQEVQDEVQSMLFIEEK | 189-209 for the proteins of SEQ No. 1150, 1192 | 2df |
| SEQ ID No. 1764 | TLPFSQK | 189-195 for the proteins of SEQ No. 1146, 1148, 1149, 1151, 1152, 1154, 1155, 1156, 1158, 1159, 1160, 1162, 1163, 1164, 1165, 1166, 1167, 1174, 1175, 1176, 1177, 1178, 1179, 1180, 1182, 1183, 1184, 1185, 1194, 1195, 1196, 1202, 1204, 1209, 1210, 1211, 1212, 1213, 1214, 1215, 1226, 1230, 1231, 1232, 1233, 1236, 1238, 1245, 1260, 1261, 1265, 1266; 183-189 for the protein of sequence SEQ ID No. 1189; 183-189 for the protein of sequence SEQ ID No. 1190 | 2df |
| SEQ ID No. 1765 | TLPSSQK | 189-195 for the proteins of SEQ No. 1237 | 2df |

| Peptide SEQ ID No. | Amino acid sequence | Position of the peptide in the OXA protein(s) | Clinical interest |
|---|---|---|---|
| SEQ ID No. 1766 | TLQNGWFEGFIISK | 225-238 for the proteins of SEQ No. 1118, 1134; 210-223 for the protein of sequence SEQ ID No. 1119 | 2d |
| SEQ ID No. 1767 | TMQEYLNK | 123-130 for the proteins of SEQ No. 1143 | 2d |
| SEQ ID No. 1768 | TNGNSTSVYNESR | 51-63 for the proteins of SEQ No. 1113, 1121 | 2d |
| SEQ ID No. 1769 | TQTYQAYDAAR | 72-82 for the proteins of SEQ No. 1140 | 2df |
| SEQ ID No. 1770 | TTDPTIWEK | 93-101 for the proteins of SEQ No. 1256 | 2d |
| SEQ ID No. 1771 | TTTTEVFK | 96-103 for the proteins of SEQ No. 1153, 1186 | 2df |
| SEQ ID No. 1772 | TWASNDFSR | 41-49 for the proteins of SEQ No. 1143 | 2d |
| SEQ ID No. 1773 | TWDMVQR | 191-197 for the proteins of SEQ No. 1137 | 2df |
| SEQ ID No. 1774 | TWMQFSVVWVSQEITQK | 113-129 for the proteins of SEQ No. 1118, 1134; 98-114 for the protein of sequence SEQ ID No. 1119 | 2d |
| SEQ ID No. 1775 | TYPMWEK | 111-117 for the proteins of SEQ No. 1122, 1123, 1129, 1172, 1207, 1264 | 2df |
| SEQ ID No. 1776 | TYVVDPAR | 58-65 for the proteins of SEQ No. 1137 | 2df |
| SEQ ID No. 1777 | VAFSLNIEMK | 244-253 for the proteins of SEQ No. 1205 | 2df |
| SEQ ID No. 1778 | VANSLIGLSTGAVR | 70-83 for the proteins of SEQ No. 1138 | 2d |
| SEQ ID No. 1779 | VEHQR | 187-191 for the proteins of SEQ No. 1108, 1113, 1114, 1121, 1125, 1127, 1128, 1130, 1131, 1133, 1173, 1201, 1239, 1242, 1246, 1249; 176-180 for the protein of sequence SEQ ID No. 1120 | OXA |
| SEQ ID No. 1780 | VELGK | 248-252 for the proteins of SEQ No. 1138 | 2d |
| SEQ ID No. 1781 | VFDDAGVSGTFVLMDITADR | 38-57 for the proteins of SEQ No. 1137 | 2df |
| SEQ ID No. 1782 | VFLDSWAK | 88-95 for the proteins of SEQ No. 1135 | 2d |
| SEQ ID No. 1783 | VFLESWAK | 101-108 for the proteins of SEQ No. 1187, 1188, 1235 | 2d |
| SEQ ID No. 1784 | VFLSSWAQDMNLSSAIK | 89-105 for the proteins of SEQ No. 1143 | 2d |
| SEQ ID No. 1785 | VGFER | 134-138 for the proteins of SEQ No. 1137 | 2df |
| SEQ ID No. 1786 | VILVFDQVR | 55-63 for the proteins of SEQ No. 1114, 1249 | 2d |
| SEQ ID No. 1787 | VITFTK | 228-233 for the proteins of SEQ No. 1252 | 2de |
| SEQ ID No. 1788 | VMAAMVR | 158-164 for the proteins of SEQ No. 1139 | 2df |

-continued

| Peptide SEQ ID No. | Amino acid sequence | Position of the peptide in the OXA protein(s) | Clinical interest |
|---|---|---|---|
| SEQ ID No. 1789 | VPLAVMGYDAGILVDAHNPR | 58-77 for the proteins of SEQ No. 1256 | 2d |
| SEQ ID No. 1790 | VQANVK | 195-200 for the proteins of SEQ No. 1124, 1132, 1145, 1198, 1199, 1217, 1218, 1219, 1220, 1221, 1222, 1223, 1244, 1251 | 2df |
| SEQ ID No. 1791 | VQDEVK | 196-201 for the proteins of SEQ No. 1202 | 2df |
| SEQ ID No. 1792 | VQDEVQSMLFIEEK | 196-209 for the proteins of SEQ No. 1146, 1147, 1148, 1149, 1150, 1151, 1153, 1154, 1155, 1156, 1157, 1158, 1159, 1160, 1162, 1163, 1164, 1165, 1166, 1167, 1169, 1174, 1175, 1176, 1177, 1178, 1179, 1180, 1182, 1183, 1184, 1185, 1186, 1192, 1194, 1195, 1196, 1197, 1203, 1204, 1209, 1210, 1211, 1212, 1213, 1215, 1225, 1226, 1230, 1231, 1232, 1233, 1236, 1237, 1238, 1240, 1241, 1245, 1253, 1260, 1261, 1265, 1266; 190-203 for the protein of sequence SEQ ID No. 1189; 190-203 for the protein of sequence SEQ ID No. 1190 | 2df |
| SEQ ID No. 1793 | VQDEVQSMLFIEEMNGNK | 196-213 for the proteins of SEQ No. 1170, 1181 | 2df |
| SEQ ID No. 1794 | VQDGVQSMLFIEEK | 196-209 for the proteins of SEQ No. 1214 | 2df |
| SEQ ID No. 1795 | VQHEVQSMLFIEEK | 196-209 for the proteins of SEQ No. 1152 | 2df |
| SEQ ID No. 1796 | VSCLPCYQVVSHK | 138-150 for the proteins of SEQ No. 1140 | 2df |
| SEQ ID No. 1797 | VSCVWCYQALAR | 114-125 for the proteins of SEQ No. 1228 | 2df |
| SEQ ID No. 1798 | VSDVCSEVTAEGWQEVR | 37-53 for the proteins of SEQ No. 1139 | 2df |
| SEQ ID No. 1799 | VSEVEGWQIHGK | 186-197 for the proteins of SEQ No. 1105 | 2d |
| SEQ ID No. 1800 | VSFSLNIEMK | 244-253 for the proteins of SEQ No. 1224 | 2df |
| SEQ ID No. 1801 | VSPCSSFK | 54-61 for the proteins of SEQ No. 1107 | 2d |
| SEQ ID No. 1802 | VSQVPAYK | 105-112 for the proteins of SEQ No. 1135 | 2d |
| SEQ ID No. 1803 | VVFAR | 229-233 for the proteins of SEQ No. 1256; 239-243 for the protein of sequence SEQ ID No. 1107; 240-244 for the protein of sequence SEQ ID No. 1109 | OXA |
| SEQ ID No. 1804 | WDGAK | 97-101 for the proteins of SEQ No. 1113, 1121 | 2d |
| SEQ ID No. 1805 | WDGEK | 104-108 for the proteins of SEQ No. 1151, 1160, 1177, 1180, 1182 | 2df |
| SEQ ID No. 1806 | WDGHIYDFPDWNR | 92-104 for the proteins of SEQ No. 1228 | 2df |
| SEQ ID No. 1807 | WDGIK | 97-101 for the proteins of SEQ No. 1114, 1249 | 2d |
| SEQ ID No. 1808 | WDGKPR | 92-97 for the proteins of SEQ No. 1110, 1115, 1116, 1117, 1126, 1141, 1193, 1200, 1229, 1247, 1250, 1259, 1262, 1263; 83-88 for the protein of sequence SEQ ID No. 1106; 83-88 | OXA |

-continued

| Peptide SEQ ID No. | Amino acid sequence | Position of the peptide in the OXA protein(s) | Clinical interest |
|---|---|---|---|
| | | for the protein of sequence SEQ ID No. 1111; 83-88 for the protein of sequence SEQ ID No. 1112; 116-121 for the protein of sequence SEQ ID No. 1140; 107-112 for the protein of sequence SEQ ID No. 1168; 107-112 for the protein of sequence SEQ ID No. 1171; 107-112 for the protein of sequence SEQ ID No. 1216; 93-98 for the protein of sequence SEQ ID No. 1248 | |
| SEQ ID No. 1809 | WDGQK | 104-108 for the proteins of SEQ No. 1146, 1147, 1150, 1153, 1154, 1155, 1157, 1161, 1163, 1164, 1165, 1169, 1170, 1181, 1186, 1192, 1197, 1203, 1204, 1206, 1225, 1226, 1240, 1241, 1253, 1261, 1266; 98-102 for the protein of sequence SEQ ID No. 1189; 98-102 for the protein of sequence SEQ ID No. 1190 | 2df |
| SEQ ID No. 1810 | WDGQTR | 95-100 for the proteins of SEQ No. 1136, 1142, 1208, 1234, 1243 | 2df |
| SEQ ID No. 1811 | WDGVK | 97-101 for the proteins of SEQ No. 1127, 1130, 1133, 1242 | 2d |
| SEQ ID No. 1812 | WDGVNR | 97-102 for the proteins of SEQ No. 1108, 1125, 1128, 1131, 1173, 1201, 1239, 1246; 86-91 for the protein of sequence SEQ ID No. 1120 | OXA |
| SEQ ID No. 1813 | WDYKPEFNGYK | 78-88 for the proteins of SEQ No. 1256; 89-99 for the protein of sequence SEQ ID No. 1109 | OXA |
| SEQ ID No. 1814 | WETYSVVWFSQQITEWLGMER | 97-117 for the proteins of SEQ No. 1105 | 2d |
| SEQ ID No. 1815 | WNGQK | 104-108 for the proteins of SEQ No. 1152, 1176, 1202, 1265 | 2df |
| SEQ ID No. 1816 | YAQAK | 155-159 for the proteins of SEQ No. 1140 | 2df |
| SEQ ID No. 1817 | YFSDFNAK | 34-41 for the proteins of SEQ No. 1113, 1121 | 2d |
| SEQ ID No. 1818 | YGTHLDR | 68-74 for the proteins of SEQ No. 1168, 1171, 1216 | 2df |
| SEQ ID No. 1819 | YIIHNK | 54-59 for the proteins of SEQ No. 1144, 1187, 1188, 1235 | 2d |
| SEQ ID No. 1820 | YLDELVK | 245-251 for the proteins of SEQ No. 1143 | 2d |
| SEQ ID No. 1821 | YLMITEAGR | 195-203 for the proteins of SEQ No. 1242 | OXA |
| SEQ ID No. 1822 | YLNLFSYGNANIGGGIDK | 135-152 for the proteins of SEQ No. 1247, 1263 | OXA |
| SEQ ID No. 1823 | YNGEK | 96-100 for the proteins of SEQ No. 1187, 1188, 1235 | 2d |
| SEQ ID No. 1824 | YPHNPR | 88-93 for the proteins of SEQ No. 1252 | 2de |
| SEQ ID No. 1825 | YPVWYSQQVAHHLGAQR | 103-120 for the proteins of SEQ No. 1255 | 2d |
| SEQ ID No. 1826 | YSNVLAFK | 106-113 for the proteins of SEQ No. 1143 | 2d |
| SEQ ID No. 1827 | YSPASTFK | 68-75 for the proteins of SEQ No. 1108, 1113, 1114, 1121, 1125, 1127, 1128, 1130, 1131, 1133, 1173, 1201, 1239, 1242, 1246, 1249; 57-64 for the protein of sequence SEQ ID No. 1120 | OXA |

| Peptide SEQ ID No. | Amino acid sequence | Position of the peptide in the OXA protein(s) | Clinical interest |
|---|---|---|---|
| SEQ ID No. 1828 | YSVVPVYQQLAR | 141-152 for the proteins of SEQ No. 1139 | 2df |
| SEQ ID No. 1829 | YSVVWYSQLTAK | 109-120 for the proteins of SEQ No. 1191 | 2d |
| SEQ ID No. 1830 | YSVVWYSQQVAHHLGAQR | 103-120 for the proteins of SEQ No. 1254, 1257, 1258 | 2d |
| SEQ ID No. 1831 | YTPASTFK | 55-62 for the proteins of SEQ No. 1191 | 2d |
| SEQ ID No. 1832 | YTSAFGYGNADVSGEPGK | 130-147 for the proteins of SEQ No. 1191 | 2d |
| SEQ ID No. 1833 | YVFVSALTGNLGSNLTSSIK | 228-247 for the proteins of SEQ No. 1119; 243-262 for the protein of sequence SEQ ID No. 1118 | 2d |
| SEQ ID No. 1834 | YVFVSALTGSLGSNLTSSIK | 243-262 for the proteins of SEQ No. 1134 | 2d |
| SEQ ID No. 1835 | YVGHDR | 50-55 for the proteins of SEQ No. 1138 | 2d |
| SEQ ID No. 2160 | ANQAFLPASTFK | 62-73 for the proteins of SEQ No. 1136, 1142, 1208, 1234, 1243 | 2df |
| SEQ ID No. 2161 | DEHQVFK | 88-94 for the proteins of SEQ No. 1136, 1142, 1208, 1234, 1243 | 2df |
| SEQ ID No. 2162 | DHNLITAMK | 108-116 for the proteins of SEQ No. 1136, 1208, 1234 | 2df |
| SEQ ID No. 2163 | DIATWNR | 101-107 for the proteins of SEQ No. 1136, 1208, 1234 | 2df |
| SEQ ID No. 2164 | IPNSLIALDLGVVK | 74-87 for the proteins of SEQ No. 1136, 1142, 1208, 1234, 1243 | 2df |
| SEQ ID No. 2165 | ISATEQISFLR | 164-174 for the proteins of SEQ No. 1136, 1208, 1234 | 2df |
| SEQ ID No. 2166 | QAMLTEANGDYIIR | 193-206 for the proteins of SEQ No. 1136, 1208, 1234, 1243 | 2df |
| SEQ ID No. 2167 | QQGFTNNLK | 52-60 for the proteins of SEQ No. 1136, 1142, 1208, 1234, 1243 | 2df |
| SEQ ID No. 2168 | SQGVVVLWNENK | 40-51 for the proteins of SEQ No. 1136, 1208, 1234, 1243 | 2df |
| SEQ ID No. 2169 | SWNAHFTEHK | 30-39 for the proteins of SEQ No. 1136, 1208, 1234, 1243 | 2df |
| SEQ ID No. 2170 | VLALSAVFLVASIIGMPAVAK | 3-23 for the proteins of SEQ No. 1136, 1208, 1234, 1243 | 2df |
| SEQ ID No. 2171 | YSVVPVYQEFAR | 117-128 for the proteins of SEQ No. 1136, 1142, 1208, 1234, 1243 | 2df |

In the clinical interest column, the entries 2d, 2de, 2df correspond to the functional subgroups of OXA beta-lactamases which the corresponding peptide makes it possible to detect. Therefore, the detection of a 2df peptide will indicate the presence of a carbapenemase beta-lactamase capable of hydrolysing carbapenems.

The entry 2de will indicate the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The entry OXA indicates a common peptide between at least two of the subgroups 2d, 2de and 2df. The corresponding peptide indicates the presence of an OXA beta-lactamase and the presence of a mechanism of resistance at least to penicillins and to first-generation cephalosporins.

The detection of a mechanism of resistance to ESBL (extended-spectrum beta-lactamase) cephalosporins, induced by the OXA protein, is characterised by the detection of at least one resistance-marking 2de peptide chosen from the sequences SEQ ID No. 1277, 1297, 1323, 1344, 1368, 1369, 1373, 1375, 1392, 1421, 1423, 1427, 1429, 1439, 1444, 1446, 1450, 1451, 1457, 1465, 1468, 1490, 1491, 1495, 1498, 1534, 1543, 1545, 1575, 1589, 1597, 1598, 1600, 1602, 1657, 1713, 1721, 1724, 1740, 1742, 1787, 1824, 1268, 1269, 1270, 1271, 1272, 1278, 1279, 1280, 1281, 1283, 1285, 1288, 1290, 1295, 1299, 1300, 1301, 1302, 1303, 1304, 1305, 1306, 1307, 1308, 1309, 1310, 1314, 1315, 1316, 1317, 1318, 1319, 1320, 1332, 1337, 1339, 1340, 1341, 1342, 1350, 1354, 1355, 1356, 1357, 1358, 1359, 1360, 1365, 1366, 1367, 1386, 1389, 1390, 1391, 1393, 1394, 1402, 1404, 1405, 1407, 1408, 1413, 1414, 1419, 1420, 1425, 1432, 1433, 1440, 1447, 1448, 1456, 1471, 1472, 1477, 1478, 1480, 1485, 1487, 1488, 1499, 1504, 1506, 1508, 1509, 1510, 1513, 1514, 1515, 1516, 1521, 1522, 1525, 1526, 1530, 1533, 1539, 1540, 1548, 1550, 1551, 1552, 1553, 1554, 1555, 1556, 1559, 1567, 1569, 1570, 1571, 1572, 1574, 1577, 1582, 1590, 1592, 1595, 1596, 1605, 1609, 1610, 1611, 1612, 1613, 1614, 1615, 1616, 1617, 1618, 1620, 1626, 1627, 1628, 1632, 1633, 1634, 1635, 1637, 1638, 1639, 1640, 1652, 1653, 1656, 1660, 1661, 1662, 1664, 1665, 1666, 1669, 1670, 1671, 1672, 1673, 1677, 1678, 1680, 1681, 1685, 1687, 1695, 1696, 1697, 1703, 1704, 1706, 1707, 1708, 1709, 1712, 1714, 1715, 1717, 1720, 1722, 1725, 1727, 1729, 1730, 1732, 1733, 1737, 1738, 1743, 1746, 1748, 1751, 1752, 1753, 1754, 1755, 1758, 1759, 1760, 1761, 1762, 1763, 1764, 1765, 1769, 1771, 1773, 1775, 1776, 1777, 1781, 1785, 1788, 1790, 1791, 1792, 1793, 1794, 1795, 1796, 1797, 1798, 1800, 1805, 1806, 1809, 1810, 1815, 1816, 1818, 1828, 2160, 2161, 2162, 2163, 2164, 2165, 2166, 2167, 2168, 2169, 2170, 2171.

The detection of a mechanism of resistance to carbapenems or to cephalosporins, induced by the expression of the GES protein, is characterised by the detection of at least one peptide belonging to the GES protein and to its different sequence variants SEQ ID No. 2114 to SEQ ID No. 2130.

SEQ ID No. 2114:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2115:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2116:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQLAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2117:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMNDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2118:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMSDNTPG

-continued

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2119:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMSDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2120:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGSRNDIGFFKAQERDYAVAVYTTAPKLSAVERDELVASVGQVITQLILS

TDK

SEQ ID No. 2121:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGARNDIGFFKAQERDYAVAVYTTAPKLSAVERDELVASVGQVITQLILS

TDK

SEQ ID No. 2122:
MRFIHALLLAGTAHSAYASEKLTFKTDLEKLEREKAAQIGVAIVDPQGEIVAGHRTAQ

RFAMCSTFKFPLAALVFERIDSGTERGDRKLSYGPDMIVEWSPATERFLASGHMTV

LEAAQAAVQLCDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2123:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMNDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2124:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKESEMSDNTPG

DLRDTTTPIAMARTVAKVLYGGALTSTSTHTIERWLIGNQTGDATLRAGFPKDWVVG

-continued

EKTGTCANGGRNDIGFFKAQERDYAVAVYTTAPKLSAVERDELVASVGQVITQLILS

TDK

SEQ ID No. 2125:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMSDNTPG

DLRDTTTPIAMARTVAKVLYGGALTSTSTHTIERWLIGNQTGDATLRAGFPKDWVVG

EKTGTCANGARNDIGFFKAQERDYAVAVYTTAPKLSAVERDELVASVGQVITQLILS

TDK

SEQ ID No. 2126:
MRFIHALLLAGIAHSAYASEKLTFKTDLEKLEREKAAEIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMSDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2127:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGARNDIGFFKAQERDYAVAVYTTAPKLSAVERDELVASVGQVITQLILS

TDK

SEQ ID No. 2128:
MRFIHALLLAGIAHSAYASEKLTFKTDLEKLEREKAAQIGVAIVDPQGEIVAGHRTAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2129:
MRFIHALLLAGIAHSAYASEKLTFKTDLEKLEREKAAQIGVAIVDPQGEIVAGHRTAQ

RFAMCSTFKFPLAALVFERIDSGTERGDRKLSYGPDMIVKWSPATERFLASGHMTV

LEAAQAAVQLSDNGATNLLLREIGGPAAMTQYFRKIGDSVSRLDRKEPEMSDNTPG

DLRDTTTPIAMARTVAKVLYGGALTSTSTHTIERWLIGNQTGDATLRAGFPKDWVVG

EKTGTCANGGRNDIGFFKAQERDYAVAVYTTAPKLSAVERDELVASVGQVITQLILS

TDK

SEQ ID No. 2130:
MRFIHALLLAGIAHSAYASEKLTFKTDLEKLEREKAAQIGVAIVDPQGEIVAGHRMAQ

RFAMCSTFKFPLAALVFERIDSGTERGDRKLSYGPDMIVEWSPATERFLASGHMTV

LEAAQAAVQLSDNGATNLLLREIGGPAAMTQYFRKIGDSVSRLDRKEPEMGDNTPG

DLRDTTTPIAMARTVAKVLYGGALTSTSTHTIERWLIGNQTGDATLRAGFPKDWVVG

EKTGACANGARNDIGFFKAQERDYAVAVYTTAPKLSAVERDELVASVGQVITQLILS

TDK said peptides being chosen, preferably, from the peptides of sequence SEQ ID No. 2131 to SEQ ID No. 2159 as defined hereafter:

| Peptide SEQ ID No. | Amino acid sequence | Position of the peptide in the GES protein(s) | Clinical interest |
|---|---|---|---|
| SEQ ID No. 2131 | AAEIGVAIVDPQGEIVAGHR | 36-55 for the proteins of SEQ No. 2126 | carba |
| SEQ ID No. 2132 | AAQIGVAIVDPQGEIVAGHR | 36-55 for the proteins of SEQ No. 2114, 2115, 2116, 2117, 2118, 2119, 2120, 2121, 2122, 2123, 2124, 2125, 2127, 2128, 2129, 2130 | ESBL |
| SEQ ID No. 2133 | AGFPK | 218-222 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2134 | DTTTPIAMAR | 174-183 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2135 | DWVVGEK | 223-229 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2136 | DYAVAVYTTAPK | 250-261 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2137 | EIGGPAAMTQYFR | 136-148 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2138 | EPEMGDNTPGDLR | 161-173 for the proteins of SEQ No. 2114, 2115, 2116, 2120, 2121, 2122, 2127, 2128, 2130 | ESBL |
| SEQ ID No. 2139 | EPEMNDNTPGDLR | 161-173 for the proteins of SEQ No. 2117, 2123 | carba |
| SEQ ID No. 2140 | EPEMSDNTPGDLR | 161-173 for the proteins of SEQ No. 2118, 2119, 2125, 2126, 2129 | carba |
| SEQ ID No. 2141 | ESEMSDNTPGDLR | 161-173 for the proteins of SEQ No. 2124 | carba |
| SEQ ID No. 2142 | FAMCSTFK | 60-67 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2143 | FIHALLLAGIAHSAYASEK | 3-21 for the proteins of SEQ No. 2114, 2115, 2116, 2117, 2118, 2119, 2120, 2121, 2123, 2124, 2125, 2126, 2127, 2128, 2129, 2130 | ESBL |
| SEQ ID No. 2144 | FIHALLLAGTAHSAYASEK | 3-21 for the proteins of SEQ No. 2122 | carba |
| SEQ ID No. 2145 | FPLAALVFER | 68-77 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2146 | IDSGTER | 78-84 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2147 | IGDSVSR | 150-156 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2148 | LSAVER | 262-267 for the proteins of SEQ No. 2114, 2115, 2116, 2117, 2118, 2119, 2120, 2121, 2122, 2123, 2124, 2125, 2126, 2127, 2128, 2129, 2130 | ESBL |

| Peptide SEQ ID No. | Amino acid sequence | Position of the peptide in the GES protein(s) | Clinical interest |
|---|---|---|---|
| SEQ ID No. 2149 | LSYGPDMIVEWSPATER | 89-105 for the proteins of SEQ No. 2114, 2116, 2117, 2118, 2120, 2121, 2122, 2124, 2125, 2126, 2130 | ESBL |
| SEQ ID No. 2150 | LSYGPDMIVK | 89-98 for the proteins of SEQ No. 2115, 2119, 2123, 2127, 2128, 2129 | carba |
| SEQ ID No. 2151 | NDIGFFK | 239-245 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2152 | TDLEK | 26-30 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2153 | TGACANGAR | 230-238 for the proteins of SEQ No. 2130 | carba |
| SEQ ID No. 2154 | TGTCANGAR | 230-238 for the proteins of SEQ No. 2121, 2125, 2127 | carba |
| SEQ ID No. 2155 | TGTCANGGR | 230-238 for the proteins of SEQ No. 2114, 2115, 2116, 2117, 2118, 2119, 2122, 2123, 2124, 2126, 2128, 2129 | ESBL |
| SEQ ID No. 2156 | TGTCANGSR | 230-238 for the proteins of SEQ No. 2120 | carba |
| SEQ ID No. 2157 | VLYGGALTSTSTHTIER | 188-204 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2158 | WLIGNQTGDATLR | 205-217 for the proteins of SEQ No. 2114, 2115, 2116, 2117, 2118, 2119, 2120, 2121, 2122, 2123, 2124, 2125, 2126, 2127, 2128, 2129, 2130 | ESBL |
| SEQ ID No. 2159 | WSPATER | 99-105 for the proteins of SEQ No. 2114, 2115, 2116, 2117, 2118, 2119, 2120, 2121, 2122, 2123, 2124, 2125, 2126, 2127, 2128, 2129, 2130 | carba |

In the clinical interest column, the ESBL and carba entries correspond to the GES beta-lactamase activities which the corresponding peptide makes it possible to detect. Therefore, the detection of a carba peptide will indicate the presence of a carbapenemase beta-lactamase capable of hydrolysing carbapenems, penicillins, first-generation cephalosporins such as cephaloridine and cefalotin, and at least one antibiotic from the oxyimino-beta-lactam class such as cefotaxime, ceftazidime or the monobactames such as aztreonam.

If no peptide referred to as carba is detected, the detection of a peptide referred to as ESBL will indicate the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The detection of a mechanism of resistance to cephalosporinases with an extended spectrum (ESBL) induced by the GES protein is thus characterised by the detection of at least one resistance-marking ESBL peptide chosen from the sequences SEQ ID No. 2131 to SEQ ID No. 2159.

Certain peptide sequences can be common to several resistance mechanisms. Therefore, the following sequences are identical:

SEQ ID No. 834 and SEQ ID No. 978
SEQ ID No. 833 and SEQ ID No. 977
SEQ ID No. 832 and SEQ ID No. 976
SEQ ID No. 831 and SEQ ID No. 975
SEQ ID No. 826 and SEQ ID No. 974
SEQ ID No. 825 and SEQ ID No. 973
SEQ ID No. 824 and SEQ ID No. 972
SEQ ID No. 823 and SEQ ID No. 971
SEQ ID No. 822 and SEQ ID No. 970
SEQ ID No. 817 and SEQ ID No. 969
SEQ ID No. 813 and SEQ ID No. 967
SEQ ID No. 802 and SEQ ID No. 964
SEQ ID No. 798 and SEQ ID No. 963
SEQ ID No. 666 and SEQ ID No. 895
SEQ ID No. 350 and SEQ ID No. 1035
SEQ ID No. 349 and SEQ ID No. 1031
SEQ ID No. 347 and SEQ ID No. 1030
SEQ ID No. 346 and SEQ ID No. 1029
SEQ ID No. 345 and SEQ ID No. 1028
SEQ ID No. 343 and SEQ ID No. 1037 and SEQ ID No. 725
SEQ ID No. 342 and SEQ ID No. 1026
SEQ ID No. 341 and SEQ ID No. 1025
SEQ ID No. 340 and SEQ ID No. 1024
SEQ ID No. 339 and SEQ ID No. 1023

SEQ ID No. 338 and SEQ ID No. 1020
SEQ ID No. 337 and SEQ ID No. 1036 and SEQ ID No. 719
SEQ ID No. 337 and SEQ ID No. 1036
SEQ ID No. 336 and SEQ ID No. 841 and SEQ ID No. 981
SEQ ID No. 323 and SEQ ID No. 840 and SEQ ID No. 980
SEQ ID No. 315 and SEQ ID No. 839 and SEQ ID No. 948 and SEQ ID No. 979
SEQ ID No. 240 and SEQ ID No. 679
SEQ ID No. 184 and SEQ ID No. 626
SEQ ID No. 182 and SEQ ID No. 625
SEQ ID No. 1034 and SEQ ID No. 1999
SEQ ID No. 1032 and SEQ ID No. 1988
SEQ ID No. 1027 and SEQ ID No. 1970
SEQ ID No. 1022 and SEQ ID No. 1952
SEQ ID No. 1021 and SEQ ID No. 1937
SEQ ID No. 1019 and SEQ ID No. 1933
SEQ ID No. 809 and SEQ ID No. 966
SEQ ID No. 1033 and SEQ ID No. 1989

In all cases, the sequences above indicate the expression of a mechanism of resistance to cephalosporins.

The method of the invention and its advantages will become apparent from the rest of the present description which presents several non-limiting examples of implementation of said method.

EXAMPLE 1

Identification of Microorganisms from a Sample by Biochemical Profile

1. Culturing of the Sample on a Culture Medium

The optimum culture media and the optimum culture conditions are different according to the species of microorganism. By default, the sample is seeded on different media:
 sheep blood Columbia agar (bioMérieux ref. 43041) for 18 to 24 h at 35° C., in an aerobic or anaerobic atmosphere;
 TSA agar (bioMérieux ref. 43011) for 18 to 24 h at 37° C.

2. Identification of the Microorganisms

The identification is performed as follows:
1. Selection of isolated colonies
2. While maintaining the aseptic conditions, transfer of 3.0 mL of aqueous sterile saline solution (0.45-0.50% NaCl, pH 4.5 to 7.0) into a transparent plastic (polystyrene) test tube
3. With the aid of a stirrer or a sterile swab, transfer of a sufficient number of identical colonies into the saline solution tube prepared in step 2, and adjustment of the bacterial suspension between 0.50 and 0.63 McFarland with a calibrated DENSICHEK from VITEK®
4. Positioning of the bacterial suspension tube and of a VITEK® identification card on a VITEK® cartridge
5. Loading of the cartridge into the VITEK® instrument
6. The filling, sealing, incubation and reading operations are automatic
7. Acquisition of a biochemical profile
8. Identification with the VITEK® system performed by comparing to the biochemical profiles of known strains

EXAMPLE 2

Preparation of a Primary Urine Sample by Microorganism Enrichment

The following protocol is performed in 16 steps (steps 5 to 12 are optional and could be omitted if the enriched sample is subsequently treated according to examples 4 and onwards):
1. Centrifuging of 5 mL of contaminated urine, at 2000 g for 30 seconds
2. Recovery of the supernatant
3. Centrifuging at 15000 g for 5 minutes
4. Elimination of the supernatant
5. Washing of the pellet with 3 mL of distilled water by resuspension
6. Centrifuging at 15000 g for 5 minutes
7. Elimination of the supernatant
8. Place the pellet in the presence of solvent (8 acetone volumes for 1 methanol volume) for 1/10 dilution
9. Leave for 1 hour at −20° C.
10. Centrifuging at 15000 g for 5 minutes
11. Elimination of the supernatant
12. Place the pellet in the presence of solvent (8 acetone volumes for 1 methanol volume) for 1/10 dilution
13. Leave for 1 hour at −20° C.
14. Centrifuging at 15000 g for 5 minutes
15. Elimination of the supernatant
16. The pellet constitutes the microorganism-enriched sample

EXAMPLE 3

Identification of Microorganisms from a Sample by MALDI-TOF

The identification is performed as follows:
1. Transfer, with the aid of a 1 µl oese, of a portion of microorganism colony obtained according to example 1, or of an enriched sample according to example 2, and uniform deposition on a plate for MALDI-TOF mass spectrometry
2. Covering the deposit with 1 µl of matrix. The matrix used is a saturated solution of HCCA (alpha-cyano-4-hydroxycinnamic acid) in organic solvent (50% acetonitrile and 2.5% trifluoroacetic acid)
3. Drying at ambient temperature
4. Introducing the plate into the mass spectrometer
5. Acquiring a mass spectrum
6. Comparing the obtained spectrum with the spectra contained in a knowledge base
7. Identification of the microorganism by comparing the obtained peaks with those in the knowledge base

EXAMPLE 4

Identification of Microorganisms from a Sample by ESI-TOF

The identification is performed as follows:
1. Sampling of a microorganism colony, obtained according to example 1, or of an enriched sample according to example 2, and suspension in 100 µl of demineralised water.

2. Centrifuging at 3000 g for 5 minutes.
3. Elimination of the supernatant.
4. Resuspension in 100 µl of demineralised water.
5. Centrifuging at 3000 g for 5 minutes.
6. Elimination of the supernatant.
7. Resuspension in 100 µl of an acetonitrile, demineralised water and formic acid mixture (50/50/0.1%).
8. Filtration with a filter with a porosity of 0.45 µm.
9. Injection into a mass spectrometer in single MS mode.
10. Acquisition of a mass spectrum.
11. Comparing the obtained spectrum with the spectra contained in a knowledge base.
12. Identification of the microorganism by referring to reference spectra.

EXAMPLE 5

Obtaining Digested Proteins from Microorganisms

The following protocol is conventionally performed in 17 steps:
1. Sampling of a microorganism colony, obtained according to example 1, or of an enriched sample according to example 2, and suspension in 10 to 100 µl of a 6M guanidine hydrochloride solution, 50 mM Tris-HCl, pH=8.0.
2. Addition of dithiothreitol (DTT) to achieve an end concentration of 5 mM.
3. Reduction for 20 minutes at 95° C. in a water bath.
4. Cooling the tubes to ambient temperature
5. Addition of iodoacetamide to obtain an end concentration of 12.5 mM.
6. Alkylation for 40 minutes at ambient temperature and in the dark.
7. Dilution by a factor of 6 with a 50 mM $NH_4HCO_3$ solution, pH=8.0 to obtain an end guanidine hydrochloride concentration of 1M.
8. Addition of 1 µg of trypsin.
9. Digestion at 37° C. for between 6 hours and one night.
10. Addition of formic acid down to a pH below 4 to stop the reaction.
11. The sample volume is made up to 1 mL with water/0.5% (v/v) formic acid
12. Balancing of the Waters Oasis HLB columns with 1 ml of methanol and then 1 ml of $H_2O$/0.1% (v/v) formic acid
13. Deposition of the sample which runs off by gravity
14. Washing with 1 ml of $H_2O$/0.1% (v/v) formic acid
15. Elution with 1 ml of a mixture of 80% methanol and 20% water/0.1% (v/v) formic acid
16. The eluate is evaporated with a SpeedVac® SPD2010 evaporator (Thermo Electron Corporation, Waltham, Mass., United States of America) over 2 hours, in order to obtain a volume of around 100 µl.
17. The eluate is then taken up in a water/0.5% (v/v) formic acid solution in a quantity sufficient for (QSF) 250 µl

EXAMPLE 6

Identification of a Resistance to TEM Beta-Lactams

Samples Sam10 to Sam61 are identified according to one of the methods described in examples 1, 3 or 4. The identification of the species is set out in TABLE 1.

TABLE 1

| Names | Species |
|---|---|
| Sam10 | P. mirabilis |
| Sam11 | E. coli |
| Sam12 | E. aerogenes |
| Sam13 | E. coli |
| Sam14 | E. coli |
| Sam15 | E. coli |
| Sam16 | S. marcescens |
| Sam17 | E. coli |
| Sam18 | E. coli |
| Sam19 | P. mirabilis |
| Sam20 | C. freundii |
| Sam21 | E. coli |
| Sam22 | P. mirabilis |
| Sam23 | E. coli |
| Sam24 | K. pneumoniae |
| Sam25 | E. coli |
| Sam26 | K. oxytoca |
| Sam27 | P. mirabilis |
| Sam28 | E. coli |
| Sam29 | P. mirabilis |
| Sam30 | P. rettgeri |
| Sam31 | P. stuartii |
| Sam32 | S. Derby |
| Sam33 | E. coli |
| Sam34 | E. coli |
| Sam35 | E. coli |
| Sam36 | E. coli |
| Sam37 | E. coli |
| Sam38 | E. coli |
| Sam39 | E. coli |
| Sam40 | E. coli |
| Sam41 | E. coli |
| Sam42 | E. coli |
| Sam43 | E. coli |
| Sam44 | E. coli |
| Sam45 | K. pneumoniae |
| Sam46 | E. coli |
| Sam47 | K. pneumoniae |
| Sam48 | P. mirabilis |
| Sam49 | P. mirabilis |
| Sam50 | P. mirabilis |
| Sam51 | P. mirabilis |
| Sam52 | P. mirabilis |
| Sam53 | K. pneumoniae |
| Sam54 | P. mirabilis |
| Sam55 | E. coli |
| Sam56 | E. coli |
| Sam57 | P. mirabilis |
| Sam58 | E. aerogenes |
| Sam59 | E. aerogenes |
| Sam60 | E. coli |
| Sam61 | E. coli |

Samples Sam10 to Sam61 correspond to a species able to comprise a TEM resistance mechanism (Enterobacteriaceae . . . ). The following method is then performed to search for such a mechanism.

Each sample is treated according to example 5, then a volume of 50 µl of digested proteins is injected and analysed according to the following conditions:

Dionex Ultimate 3000 chromatographic channel from the Dionex Corporation (Sunnyvale, United States of America).

Waters BEH130 C18 Column, 2.1 mm inner diameter, 100 mm length, 3.5 µm particle size (Waters, Saint-Quentin En Yvelines, France).

Solvent A: $H_2O$+0.1% formic acid.

Solvent B: ACN+0.1% formic acid.

HPLC gradient defined in Table 2 hereafter:

TABLE 2

| Time (min) | Flow (μl) | Solvent A (%) | Solvent B (%) |
|---|---|---|---|
| 0 | 300 | 98 | 2 |
| 3 | 300 | 98 | 2 |
| 34 | 300 | 54.6 | 45.4 |
| 35 | 300 | 0 | 100 |
| 55 | 300 | 0 | 100 |
| 55.1 | 300 | 98 | 2 |
| 74 | 300 | 98 | 2 |

The eluate coming from the chromatographic column is directly injected into the ionising source of the QTRAP® 5500 mass spectrometer from Applied Biosystems (Foster City, United States of America).

The peptides coming from the digestion of the microorganism proteins are analysed by the mass spectrometer in MRM mode. Only the peptides indicated in TABLE 3 are detected. To this end, the fragment(s) of the peptides indicated in TABLE 3 is/are detected. The charge state of the precursor, and the possible existence of an oxidised methionine, are also indicated in TABLE 3.

TABLE 3

| Transition number | Peptide | Methionine oxidation | Fragment ion | Charge state of the precursor | Clinical interest |
|---|---|---|---|---|---|
| 1 | DAENQLGAR | no | y4 monocharged | 2 | TEM |
| 2 | DAENQLGAR | no | y6 monocharged | 2 | TEM |
| 3 | DAENQLGAR | no | y7 monocharged | 2 | TEM |
| 4 | ELTAFLHNIGDHVTR | no | y4 monocharged | 2 | TEM |
| 5 | ELTAFLHNIGDHVTR | no | y8 monocharged | 2 | TEM |
| 6 | ELTAFLHNIGDHVTR | no | y9 monocharged | 2 | TEM |
| 7 | ELTAFLHNMGDNVTR | no | y7 monocharged | 2 | 2b |
| 8 | ELTAFLHNMGDNVTR | no | y8 monocharged | 2 | 2b |
| 9 | ELTAFLHNMGDNVTR | no | y9 monocharged | 2 | 2b |
| 10 | FPMISTFK | yes | y5 monocharged | 2 | 2br |
| 11 | FPMISTFK | yes | y6 monocharged | 2 | 2br |
| 12 | FPMISTFK | yes | y7 monocharged | 2 | 2br |
| 13 | FPMISTFK | no | y5 monocharged | 2 | 2br |
| 14 | FPMISTFK | no | y6 monocharged | 2 | 2br |
| 15 | FPMISTFK | no | y7 monocharged | 2 | 2br |
| 16 | GEPELNEAIPNDER | no | y12 dicharged | 2 | 2be |
| 17 | GEPELNEAIPNDER | no | y5 monocharged | 2 | 2be |
| 18 | GEPELNEAIPNDER | no | y7 monocharged | 2 | 2be |
| 19 | GSLGIIAALGPDGKPSR | no | y10 monocharged | 2 | 2br |
| 20 | GSLGIIAALGPDGKPSR | no | y8 monocharged | 2 | 2br |
| 21 | GSLGIIAALGPDGKPSR | no | y9 monocharged | 2 | 2br |
| 22 | IHYSQNDLVEYSPVTEK | no | y6 monocharged | 3 | TEM |
| 23 | IHYSQNDLVEYSPVTEK | no | y7 monocharged | 3 | TEM |
| 24 | IHYSQNDLVEYSPVTEK | no | y8 monocharged | 3 | TEM |
| 25 | ILESFRPEER | no | b6 monocharged | 2 | TEM |
| 26 | ILESFRPEER | no | b8 monocharged | 2 | TEM |
| 27 | ILESFRPEER | no | y7 dicharged | 2 | TEM |
| 28 | IVVIYTTGGQATMDER | yes | y7 monocharged | 2 | 2be |
| 29 | IVVIYTTGGQATMDER | yes | y8 monocharged | 2 | 2be |
| 30 | IVVIYTTGGQATMDER | yes | y9 monocharged | 2 | 2be |
| 31 | IVVIYTTGGQATMDER | no | y6 monocharged | 2 | 2be |

TABLE 3-continued

| Transition number | Peptide | Methionine oxidation | Fragment ion | Charge state of the precursor | Clinical interest |
|---|---|---|---|---|---|
| 32 | IVVIYTTGGQATMDER | no | y8 monocharged | 2 | 2be |
| 33 | IVVIYTTGGQATMDER | no | y9 monocharged | 2 | 2be |
| 34 | LDSWEPELNEAIPNDER | no | y5 monocharged | 3 | 2be |
| 35 | LDSWEPELNEAIPNDER | no | y6 monocharged | 3 | 2be |
| 36 | LDSWEPELNEAIPNDER | no | y7 monocharged | 3 | 2be |
| 37 | QIAEICASLIK | no | y6 monocharged | 2 | TEM |
| 38 | QIAEICASLIK | no | y7 monocharged | 2 | TEM |
| 39 | QIAEICASLIK | no | y8 monocharged | 2 | TEM |
| 40 | SGANER | no | y3 monocharged | 2 | TEM |
| 41 | SGANER | no | y4 monocharged | 2 | TEM |
| 42 | SGANER | no | y5 monocharged | 2 | TEM |
| 43 | SGGSER | no | y3 monocharged | 2 | 2be |
| 44 | SGGSER | no | y4 monocharged | 2 | 2be |
| 45 | SGGSER | no | y5 monocharged | 2 | 2be |
| 46 | VDAGQEQLDR | no | y7 monocharged | 2 | TEM |
| 47 | VDAGQEQLDR | no | y8 monocharged | 2 | TEM |
| 48 | VDAGQEQLDR | no | y9 monocharged | 2 | TEM |
| 49 | VKPAEDK | no | y4 monocharged | 2 | 2be |
| 50 | VKPAEDK | no | y5 monocharged | 2 | 2be |
| 51 | VKPAEDK | no | y6 monocharged | 2 | 2be |
| 52 | WEPELNEAIPIDER | no | y12 dicharged | 2 | 2be |
| 53 | WEPELNEAIPIDER | no | y5 monocharged | 2 | 2be |
| 54 | WEPELNEAIPIDER | no | y7 monocharged | 2 | 2be |
| 55 | DTTMPAAMATK | yes | y7 monocharged | 2 | TEM |
| 56 | DTTMPAAMATK | yes | y8 monocharged | 2 | TEM |
| 57 | DTTMPAAMATK | yes | y9 monocharged | 2 | TEM |
| 58 | DTTMPAAMATK | no | y7 monocharged | 2 | TEM |
| 59 | DTTMPAAMATK | no | y8 monocharged | 2 | TEM |
| 60 | DTTMPAAMATK | no | y9 monocharged | 2 | TEM |
| 61 | ELTAFLHNMGDHVTR | no | y13 dicharged | 2 | TEM |
| 62 | ELTAFLHNMGDHVTR | no | y4 monocharged | 2 | TEM |
| 63 | ELTAFLHNMGDHVTR | no | y8 monocharged | 2 | TEM |
| 64 | EPELNEAIPNDER | no | y5 monocharged | 2 | TEM |
| 65 | EPELNEAIPNDER | no | y7 monocharged | 2 | TEM |
| 66 | EPELNEAIPNDER | no | y8 monocharged | 2 | TEM |
| 67 | FPMMSTFK | yes | y6 monocharged | 2 | TEM |
| 68 | FPMMSTFK | yes | y7 monocharged | 2 | TEM |
| 69 | FPMMSTFK | yes | y7 dicharged | 2 | TEM |
| 70 | FPMMSTFK | no | y6 monocharged | 2 | TEM |

TABLE 3-continued

| Transition number | Peptide | Methionine oxidation | Fragment ion | Charge state of the precursor | Clinical interest |
|---|---|---|---|---|---|
| 71 | FPMMSTFK | no | y7 monocharged | 2 | TEM |
| 72 | FPMMSTFK | no | y7 dicharged | 2 | TEM |
| 73 | GIIAALGPDGKPSR | no | y7 monocharged | 2 | TEM |
| 74 | GIIAALGPDGKPSR | no | y8 monocharged | 2 | TEM |
| 75 | GIIAALGPDGKPSR | no | y9 monocharged | 2 | TEM |
| 76 | IDAGQEQLGR | no | y7 monocharged | 2 | TEM |
| 77 | IDAGQEQLGR | no | y8 monocharged | 2 | TEM |
| 78 | IDAGQEQLGR | no | y9 monocharged | 2 | TEM |
| 79 | IHYSQNDLVK | no | y7 monocharged | 2 | 2be |
| 80 | IHYSQNDLVK | no | y8 monocharged | 2 | 2be |
| 81 | IHYSQNDLVK | no | y9 dicharged | 2 | 2be |
| 82 | IHYSQSDVVEYSPVTEK | no | y16 dicharged | 2 | TEM |
| 83 | IHYSQSDVVEYSPVTEK | no | y5 monocharged | 2 | TEM |
| 84 | IHYSQSDVVEYSPVTEK | no | y6 monocharged | 2 | TEM |
| 85 | IVVIYMTGGQATMDER | no | y6 monocharged | 2 | 2be |
| 86 | IVVIYMTGGQATMDER | no | y8 monocharged | 2 | 2be |
| 87 | IVVIYMTGGQATMDER | no | y9 monocharged | 2 | 2be |
| 88 | LDCWEPELNEAIPNDER | no | y5 monocharged | 3 | 2be |
| 89 | LDCWEPELNEAIPNDER | no | y6 monocharged | 3 | 2be |
| 90 | LDCWEPELNEAIPNDER | no | y7 monocharged | 3 | 2be |
| 91 | MSIQHFR | yes | y4 monocharged | 2 | TEM |
| 92 | MSIQHFR | yes | y5 monocharged | 2 | TEM |
| 93 | MSIQHFR | yes | y6 monocharged | 2 | TEM |
| 94 | MSIQHFR | no | y4 monocharged | 2 | TEM |
| 95 | MSIQHFR | no | y5 monocharged | 2 | TEM |
| 96 | MSIQHFR | no | y6 monocharged | 2 | TEM |
| 97 | QQLIDWMEADK | no | y5 monocharged | 2 | TEM |
| 98 | QQLIDWMEADK | no | y6 monocharged | 2 | TEM |
| 99 | QQLIDWMEADK | no | y7 monocharged | 2 | TEM |
| 100 | SGASER | no | y3 monocharged | 2 | 2be |
| 101 | SGASER | no | y4 monocharged | 2 | 2be |
| 102 | SGASER | no | y5 monocharged | 2 | 2be |
| 103 | VALIPFLAAFCLPVFAHPETLVK | no | y11 dicharged | 3 | 2ber |
| 104 | VALIPFLAAFCLPVFAHPETLVK | no | y6 monocharged | 3 | 2ber |
| 105 | VALIPFLAAFCLPVFAHPETLVK | no | y8 monocharged | 3 | 2ber |
| 106 | VGYIELDLNSGK | no | y7 monocharged | 2 | TEM |
| 107 | VGYIELDLNSGK | no | y8 monocharged | 2 | TEM |
| 108 | VGYIELDLNSGK | no | y9 monocharged | 2 | TEM |
| 109 | VLLCGAELSR | no | y6 monocharged | 2 | TEM |

TABLE 3-continued

| Transition number | Peptide | Methionine oxidation | Fragment ion | Charge state of the precursor | Clinical interest |
|---|---|---|---|---|---|
| 110 | VLLCGAELSR | no | y7 monocharged | 2 | TEM |
| 111 | VLLCGAELSR | no | y8 monocharged | 2 | TEM |
| 112 | DAEDQLGAR | no | y5 monocharged | 2 | TEM |
| 113 | DAEDQLGAR | no | y6 monocharged | 2 | TEM |
| 114 | DAEDQLGAR | no | y7 monocharged | 2 | TEM |
| 115 | ETTTPAAMATTLR | yes | y7 monocharged | 2 | 2be |
| 116 | ETTTPAAMATTLR | yes | y9 monocharged | 2 | 2be |
| 117 | ETTTPAAMATTLR | yes | y9 dicharged | 2 | 2be |
| 118 | ETTTPAAMATTLR | no | y7 monocharged | 2 | 2be |
| 119 | ETTTPAAMATTLR | no | y9 monocharged | 2 | 2be |
| 120 | ETTTPAAMATTLR | no | y9 dicharged | 2 | 2be |
| 121 | FPMVSTFK | yes | y6 monocharged | 2 | TEM |
| 122 | FPMVSTFK | yes | y7 monocharged | 2 | TEM |
| 123 | FPMVSTFK | yes | y7 dicharged | 2 | TEM |
| 124 | FPMVSTFK | no | y6 monocharged | 2 | TEM |
| 125 | FPMVSTFK | no | y7 monocharged | 2 | TEM |
| 126 | FPMVSTFK | no | y7 dicharged | 2 | TEM |
| 127 | GSGGIIAALGPDGKPSR | no | y7 monocharged | 2 | 2br |
| 128 | GSGGIIAALGPDGKPSR | no | y8 monocharged | 2 | 2br |
| 129 | GSGGIIAALGPDGKPSR | no | y9 monocharged | 2 | 2br |
| 130 | HLTDGMTVR | yes | y5 monocharged | 2 | TEM |
| 131 | HLTDGMTVR | yes | y7 monocharged | 2 | TEM |
| 132 | HLTDGMTVR | yes | y8 monocharged | 2 | TEM |
| 133 | HLTDGMTVR | no | y4 monocharged | 2 | TEM |
| 134 | HLTDGMTVR | no | y7 monocharged | 2 | TEM |
| 135 | HLTDGMTVR | no | y8 monocharged | 2 | TEM |
| 136 | IVIIYTTGSQATMDER | no | b4 monocharged | 2 | 2br |
| 137 | IVIIYTTGSQATMDER | no | y2 monocharged | 2 | 2br |
| 138 | IVIIYTTGSQATMDER | no | y9 monocharged | 2 | 2br |
| 139 | IVVIYTTGSQATMDEQNR | yes | y5 monocharged | 3 | 2br |
| 140 | IVVIYTTGSQATMDEQNR | yes | y6 monocharged | 3 | 2br |
| 141 | IVVIYTTGSQATMDEQNR | yes | y7 monocharged | 3 | 2br |
| 142 | IVVIYTTGSQATMDEQNR | no | y5 monocharged | 3 | 2br |
| 143 | IVVIYTTGSQATMDEQNR | no | y6 monocharged | 3 | 2br |
| 144 | IVVIYTTGSQATMDEQNR | no | y7 monocharged | 3 | 2br |
| 145 | LDHWEPELNEAVPNDER | no | y5 monocharged | 3 | 2be |
| 146 | LDHWEPELNEAVPNDER | no | y6 monocharged | 3 | 2be |
| 147 | LDHWEPELNEAVPNDER | no | y7 monocharged | 3 | 2be |
| 148 | LLTGELLTLASQQQLIDWMEADK | yes | b8 monocharged | 3 | TEM |

TABLE 3-continued

| Transition number | Peptide | Methionine oxidation | Fragment ion | Charge state of the precursor | Clinical interest |
|---|---|---|---|---|---|
| 149 | LLTGELLTLASQQQLIDWMEADK | yes | y6 monocharged | 3 | TEM |
| 150 | LLTGELLTLASQQQLIDWMEADK | yes | y7 monocharged | 3 | TEM |
| 151 | LLTGELLTLASQQQLIDWMEADK | no | b4 monocharged | 3 | TEM |
| 152 | LLTGELLTLASQQQLIDWMEADK | no | y6 monocharged | 3 | TEM |
| 153 | LLTGELLTLASQQQLIDWMEADK | no | y7 monocharged | 3 | TEM |
| 154 | QIAEIGASLIK | no | y7 monocharged | 2 | TEM |
| 155 | QIAEIGASLIK | no | y8 monocharged | 2 | TEM |
| 156 | QIAEIGASLIK | no | y9 monocharged | 2 | TEM |
| 157 | QTAEIGASLIK | no | y7 monocharged | 2 | 2be |
| 158 | QTAEIGASLIK | no | y8 monocharged | 2 | 2be |
| 159 | QTAEIGASLIK | no | y9 monocharged | 2 | 2be |
| 160 | SGADER | no | y3 monocharged | 2 | TEM |
| 161 | SGADER | no | y4 monocharged | 2 | TEM |
| 162 | SGADER | no | y5 monocharged | 2 | TEM |
| 163 | SGASK | no | y2 monocharged | 2 | 2be |
| 164 | SGASK | no | y3 monocharged | 2 | 2be |
| 165 | SGASK | no | y4 monocharged | 2 | 2be |
| 166 | VAGPLLR | no | y4 monocharged | 2 | TEM |
| 167 | VAGPLLR | no | y5 monocharged | 2 | TEM |
| 168 | VAGPLLR | no | y6 monocharged | 2 | TEM |
| 169 | VGYIEMDLNSGK | yes | y10 dicharged | 2 | 2be |
| 170 | VGYIEMDLNSGK | yes | y7 monocharged | 2 | 2be |
| 171 | VGYIEMDLNSGK | yes | y8 monocharged | 2 | 2be |
| 172 | VGYIEMDLNSGK | no | y7 monocharged | 2 | 2be |
| 173 | VGYIEMDLNSGK | no | y8 monocharged | 2 | 2be |
| 174 | VGYIEMDLNSGK | no | y9 monocharged | 2 | 2be |
| 175 | WEPELNEAIPNDER | no | y12 dicharged | 2 | TEM |
| 176 | WEPELNEAIPNDER | no | y5 monocharged | 2 | TEM |
| 177 | WEPELNEAIPNDER | no | y7 monocharged | 2 | TEM |
| 178 | ELTAFLHNMGEHVTR | no | y7 monocharged | 2 | 2b |
| 179 | ELTAFLHNMGEHVTR | no | y8 monocharged | 2 | 2b |
| 180 | ELTAFLHNMGEHVTR | no | y9 monocharged | 2 | 2b |
| 181 | FPMLSTFK | yes | y6 monocharged | 2 | TEM |
| 182 | FPMLSTFK | yes | y7 monocharged | 2 | TEM |
| 183 | FPMLSTFK | yes | y7 dicharged | 2 | TEM |
| 184 | FPMLSTFK | no | y6 monocharged | 2 | TEM |
| 185 | FPMLSTFK | no | y7 monocharged | 2 | TEM |
| 186 | FPMLSTFK | no | y7 dicharged | 2 | TEM |
| 187 | GSCGIIAALGPDGKPSR | no | y7 monocharged | 2 | 2br |

TABLE 3-continued

| Transition number | Peptide | Methionine oxidation | Fragment ion | Charge state of the precursor | Clinical interest |
|---|---|---|---|---|---|
| 188 | GSCGIIAALGPDGKPSR | no | y8 monocharged | 2 | 2br |
| 189 | GSCGIIAALGPDGKPSR | no | y9 monocharged | 2 | 2br |
| 190 | GSSGIIAALGPDGKPSR | no | y7 monocharged | 2 | TEM |
| 191 | GSSGIIAALGPDGKPSR | no | y8 monocharged | 2 | TEM |
| 192 | GSSGIIAALGPDGKPSR | no | y9 monocharged | 2 | TEM |
| 193 | ILESFRPEK | no | y5 monocharged | 2 | TEM |
| 194 | ILESFRPEK | no | y6 monocharged | 2 | TEM |
| 195 | ILESFRPEK | no | y7 monocharged | 2 | TEM |
| 196 | IVVIYTTGSQATMDELNR | yes | y5 monocharged | 3 | 2br |
| 197 | IVVIYTTGSQATMDELNR | yes | y6 monocharged | 3 | 2br |
| 198 | IVVIYTTGSQATMDELNR | yes | y7 monocharged | 3 | 2br |
| 199 | IVVIYTTGSQATMDELNR | no | y5 monocharged | 3 | 2br |
| 200 | IVVIYTTGSQATMDELNR | no | y6 monocharged | 3 | 2br |
| 201 | IVVIYTTGSQATMDELNR | no | y7 monocharged | 3 | 2br |
| 202 | IVVIYTTGSQATMDER | no | y6 monocharged | 2 | TEM |
| 203 | IVVIYTTGSQATMDER | no | y8 monocharged | 2 | TEM |
| 204 | IVVIYTTGSQATMDER | no | y9 monocharged | 2 | TEM |
| 205 | LHCWEPELNEAIPNDER | no | y5 monocharged | 3 | 2be |
| 206 | LHCWEPELNEAIPNDER | no | y6 monocharged | 3 | 2be |
| 207 | LHCWEPELNEAIPNDER | no | y7 monocharged | 3 | 2be |
| 208 | LLTGELLTLASR | no | y6 monocharged | 2 | TEM |
| 209 | LLTGELLTLASR | no | y7 monocharged | 2 | TEM |
| 210 | LLTGELLTLASR | no | y9 monocharged | 2 | TEM |
| 211 | QQLIDWMADK | yes | y6 monocharged | 2 | 2ber |
| 212 | QQLIDWMADK | yes | y7 monocharged | 2 | 2ber |
| 213 | QQLIDWMADK | yes | y8 monocharged | 2 | 2ber |
| 214 | QQLIDWMADK | no | y6 monocharged | 2 | 2ber |
| 215 | QQLIDWMADK | no | y7 monocharged | 2 | 2ber |
| 216 | QQLIDWMADK | no | y8 monocharged | 2 | 2ber |
| 217 | SALPAGWFIADK | no | y7 monocharged | 2 | TEM |
| 218 | SALPAGWFIADK | no | y9 monocharged | 2 | TEM |
| 219 | SALPAGWFIADK | no | y9 dicharged | 2 | TEM |
| 220 | SGAGVR | no | y3 monocharged | 2 | 2be |
| 221 | SGAGVR | no | y4 monocharged | 2 | 2be |
| 222 | SGAGVR | no | y5 monocharged | 2 | 2be |
| 223 | SGTGER | no | y3 monocharged | 2 | 2be |
| 224 | SGTGER | no | y4 monocharged | 2 | 2be |
| 225 | SGTGER | no | y5 monocharged | 2 | 2be |
| 226 | VALIPFFAAFCIPVFAHPETLVK | no | y11 dicharged | 3 | 2br |

TABLE 3-continued

| Transition number | Peptide | Methionine oxidation | Fragment ion | Charge state of the precursor | Clinical interest |
|---|---|---|---|---|---|
| 227 | VALIPFFAAFCIPVFAHPETLVK | no | y6 monocharged | 3 | 2br |
| 228 | VALIPFFAAFCIPVFAHPETLVK | no | y7 monocharged | 3 | 2br |
| 229 | VLLCGAVLSR | no | y6 monocharged | 2 | TEM |
| 230 | VLLCGAVLSR | no | y7 monocharged | 2 | TEM |
| 231 | VLLCGAVLSR | no | y8 monocharged | 2 | TEM |
| 232 | YSPVTEK | no | y4 monocharged | 2 | 2be |
| 233 | YSPVTEK | no | y5 monocharged | 2 | 2be |
| 234 | YSPVTEK | no | y6 monocharged | 2 | 2be |
| 235 | CEPELNEAIPNDER | no | y12 dicharged | 2 | 2br |
| 236 | CEPELNEAIPNDER | no | y5 monocharged | 2 | 2br |
| 237 | CEPELNEAIPNDER | no | y8 monocharged | 2 | 2br |
| 238 | DAEDQVGAR | no | y5 monocharged | 2 | 2be |
| 239 | DAEDQVGAR | no | y6 monocharged | 2 | 2be |
| 240 | DAEDQVGAR | no | y7 monocharged | 2 | 2be |
| 241 | DTTMPVAMATTLR | no | y7 monocharged | 2 | TEM |
| 242 | DTTMPVAMATTLR | no | y9 monocharged | 2 | TEM |
| 243 | DTTMPVAMATTLR | no | y9 dicharged | 2 | TEM |
| 244 | ELTAFLR | no | y4 monocharged | 2 | 2be |
| 245 | ELTAFLR | no | y5 monocharged | 2 | 2be |
| 246 | ELTAFLR | no | y6 monocharged | 2 | 2be |
| 247 | GSTGIIAALGPDGKPSR | no | y10 monocharged | 2 | TEM |
| 248 | GSTGIIAALGPDGKPSR | no | y7 monocharged | 2 | TEM |
| 249 | GSTGIIAALGPDGKPSR | no | y9 monocharged | 2 | TEM |
| 250 | HLTGGMTVR | yes | y5 monocharged | 2 | 2b |
| 251 | HLTGGMTVR | yes | y6 monocharged | 2 | 2b |
| 252 | HLTGGMTVR | yes | y7 monocharged | 2 | 2b |
| 253 | HLTGGMTVR | no | y5 monocharged | 2 | 2b |
| 254 | HLTGGMTVR | no | y6 monocharged | 2 | 2b |
| 255 | HLTGGMTVR | no | y7 monocharged | 2 | 2b |
| 256 | IVVIYMTGSQATMDELNR | yes | y6 monocharged | 3 | 2ber |
| 257 | IVVIYMTGSQATMDELNR | yes | y7 monocharged | 3 | 2ber |
| 258 | IVVIYMTGSQATMDELNR | yes | y8 monocharged | 3 | 2ber |
| 259 | IVVIYMTGSQATMDELNR | no | y5 monocharged | 3 | 2ber |
| 260 | IVVIYMTGSQATMDELNR | no | y6 monocharged | 3 | 2ber |
| 261 | IVVIYMTGSQATMDELNR | no | y7 monocharged | 3 | 2ber |
| 262 | LDHWEPELNEAIPNDER | no | y5 monocharged | 3 | 2be |
| 263 | LDHWEPELNEAIPNDER | no | y6 monocharged | 3 | 2be |
| 264 | LDHWEPELNEAIPNDER | no | y7 monocharged | 3 | 2be |
| 265 | LLTSELLTLASR | no | y10 monocharged | 2 | TEM |

TABLE 3-continued

| Transition number | Peptide | Methionine oxidation | Fragment ion | Charge state of the precursor | Clinical interest |
|---|---|---|---|---|---|
| 266 | LLTSELLTLASR | no | y7 monocharged | 2 | TEM |
| 267 | LLTSELLTLASR | no | y9 monocharged | 2 | TEM |
| 268 | QIAEIGGSLIK | no | y7 monocharged | 2 | 2ber |
| 269 | QIAEIGGSLIK | no | y8 monocharged | 2 | 2ber |
| 270 | QIAEIGGSLIK | no | y9 monocharged | 2 | 2ber |
| 271 | QQLIDWMEVDK | yes | y6 monocharged | 2 | TEM |
| 272 | QQLIDWMEVDK | yes | y7 monocharged | 2 | TEM |
| 273 | QQLIDWMEVDK | yes | y8 monocharged | 2 | TEM |
| 274 | QQLIDWMEVDK | no | y5 monocharged | 2 | TEM |
| 275 | QQLIDWMEVDK | no | y6 monocharged | 2 | TEM |
| 276 | QQLIDWMEVDK | no | y7 monocharged | 2 | TEM |
| 277 | SVLPAGWFIADK | no | y10 dicharged | 2 | 2be |
| 278 | SVLPAGWFIADK | no | y9 monocharged | 2 | 2be |
| 279 | SVLPAGWFIADK | no | y9 dicharged | 2 | 2be |
| 280 | VAGPLMR | yes | y4 monocharged | 2 | 2br |
| 281 | VAGPLMR | yes | y5 monocharged | 2 | 2br |
| 282 | VAGPLMR | yes | y6 monocharged | 2 | 2br |
| 283 | VAGPLMR | no | y4 monocharged | 2 | 2br |
| 284 | VAGPLMR | no | y5 monocharged | 2 | 2br |
| 285 | VAGPLMR | no | y6 monocharged | 2 | 2br |
| 286 | VALIPFFAAFCLPVFAHPDTLVK | no | y11 dicharged | 3 | TEM |
| 287 | VALIPFFAAFCLPVFAHPDTLVK | no | y17 dicharged | 3 | TEM |
| 288 | VALIPFFAAFCLPVFAHPDTLVK | no | y6 monocharged | 3 | TEM |
| 289 | VALIPFFAAFCLPVFAHPK | no | y15 dicharged | 3 | TEM |
| 290 | VALIPFFAAFCLPVFAHPK | no | y7 monocharged | 3 | TEM |
| 291 | VALIPFFAAFCLPVFAHPK | no | y9 dicharged | 3 | TEM |
| 292 | VEDAEDQLGAR | no | y7 monocharged | 2 | 2b |
| 293 | VEDAEDQLGAR | no | y8 monocharged | 2 | 2b |
| 294 | VEDAEDQLGAR | no | y9 monocharged | 2 | 2b |
| 295 | DAEDQLGSTSGYIELDLNSGK | no | y7 monocharged | 3 | 2ber |
| 296 | DAEDQLGSTSGYIELDLNSGK | no | y8 monocharged | 3 | 2ber |
| 297 | DAEDQLGSTSGYIELDLNSGK | no | y9 monocharged | 3 | 2ber |
| 298 | DTTMPAAMATTLR | no | y7 monocharged | 2 | TEM |
| 299 | DTTMPAAMATTLR | no | y8 monocharged | 2 | TEM |
| 300 | DTTMPAAMATTLR | no | y9 monocharged | 2 | TEM |
| 301 | DTTTPAAMATTLR | yes | y7 monocharged | 2 | TEM |
| 302 | DTTTPAAMATTLR | yes | y8 monocharged | 2 | TEM |
| 303 | DTTTPAAMATTLR | yes | y9 dicharged | 2 | TEM |
| 304 | DTTTPAAMATTLR | no | y7 monocharged | 2 | TEM |

TABLE 3-continued

| Transition number | Peptide | Methionine oxidation | Fragment ion | Charge state of the precursor | Clinical interest |
|---|---|---|---|---|---|
| 305 | DTTTPAAMATTLR | no | y9 monocharged | 2 | TEM |
| 306 | DTTTPAAMATTLR | no | y9 dicharged | 2 | TEM |
| 307 | GSHGIIAALGPDGKPSR | no | b6 monocharged | 2 | 2br |
| 308 | GSHGIIAALGPDGKPSR | no | y15 dicharged | 2 | 2br |
| 309 | GSHGIIAALGPDGKPSR | no | y8 monocharged | 2 | 2br |
| 310 | HLPDGMTVR | no | y5 monocharged | 2 | TEM |
| 311 | HLPDGMTVR | no | y7 monocharged | 2 | TEM |
| 312 | HLPDGMTVR | no | y8 monocharged | 2 | TEM |
| 313 | IHYSQSDLVEYSPVTEK | no | y16 dicharged | 2 | 2be |
| 314 | IHYSQSDLVEYSPVTEK | no | y7 monocharged | 2 | 2be |
| 315 | IHYSQSDLVEYSPVTEK | no | y8 monocharged | 2 | 2be |
| 316 | IVVIYMTGSQATMDER | no | y6 monocharged | 2 | TEM |
| 317 | IVVIYMTGSQATMDER | no | y8 monocharged | 2 | TEM |
| 318 | IVVIYMTGSQATMDER | no | y9 monocharged | 2 | TEM |
| 319 | LLTDELLTLASR | no | y5 monocharged | 2 | 2be |
| 320 | LLTDELLTLASR | no | y6 monocharged | 2 | 2be |
| 321 | LLTDELLTLASR | no | y7 monocharged | 2 | 2be |
| 322 | NMGDHVTR | yes | y4 monocharged | 2 | 2be |
| 323 | NMGDHVTR | yes | y5 monocharged | 2 | 2be |
| 324 | NMGDHVTR | yes | y6 monocharged | 2 | 2be |
| 325 | NMGDHVTR | no | y4 monocharged | 2 | 2be |
| 326 | NMGDHVTR | no | y5 monocharged | 2 | 2be |
| 327 | NMGDHVTR | no | y6 monocharged | 2 | 2be |
| 328 | QIVEIGASLIK | no | y7 monocharged | 2 | 2be |
| 329 | QIVEIGASLIK | no | y8 monocharged | 2 | 2be |
| 330 | QIVEIGASLIK | no | y9 monocharged | 2 | 2be |
| 331 | SGAGER | no | y3 monocharged | 2 | TEM |
| 332 | SGAGER | no | y4 monocharged | 2 | TEM |
| 333 | SGAGER | no | y5 monocharged | 2 | TEM |
| 334 | VAEPLLR | no | y4 monocharged | 2 | 2b |
| 335 | VAEPLLR | no | y5 monocharged | 2 | 2b |
| 336 | VAEPLLR | no | y6 monocharged | 2 | 2b |
| 337 | VALIPFFAAFCFPVFAHPETLVK | no | b11 monocharged | 3 | TEM |
| 338 | VALIPFFAAFCFPVFAHPETLVK | no | y11 dicharged | 3 | TEM |
| 339 | VALIPFFAAFCFPVFAHPETLVK | no | y6 monocharged | 3 | TEM |
| 340 | VALIPFFAAFCLPVFAHPETLVK | no | b7 monocharged | 3 | TEM |
| 341 | VALIPFFAAFCLPVFAHPETLVK | no | y11 dicharged | 3 | TEM |
| 342 | VALIPFFAAFCLPVFAHPETLVK | no | y6 monocharged | 3 | TEM |

TABLE 3-continued

| Transition number | Peptide | Methionine oxidation | Fragment ion | Charge state of the precursor | Clinical interest |
|---|---|---|---|---|---|
| 343 | VDAGQEQLGR | no | y5 monocharged | 2 | TEM |
| 344 | VDAGQEQLGR | no | y7 monocharged | 2 | TEM |
| 345 | VDAGQEQLGR | no | y8 monocharged | 2 | TEM |
| 346 | VGYIELDPNSGK | no | y5 monocharged | 2 | 2be |
| 347 | VGYIELDPNSGK | no | y7 monocharged | 2 | 2be |
| 348 | VGYIELDPNSGK | no | y8 monocharged | 2 | 2be |

The transitions mentioned in TABLE 3 are detected by using the parameters set out in TABLE 4. The precursor peptide retention time and the transitions, i.e. the (m/z)1 ratio in Q1 and (m/z)2 ratio in Q3, as well as the collision energy used to fragment the precursor ion, are indicated in TABLE 4. The threshold above which the transition is considered to be detected is also indicated in TABLE 4.

TABLE 4

| Transition number | Retention time (minutes) | (m/z) filtered in Q1 | (m/z) filtered in Q3 | Collision energy (eV) | Positivity threshold |
|---|---|---|---|---|---|
| 1 | 9.9 | 487.24 | 416.26 | 26 | 2500 |
| 2 | 9.9 | 487.24 | 658.36 | 26 | 2500 |
| 3 | 9.9 | 487.24 | 787.41 | 26 | 2500 |
| 4 | 19.3 | 861.95 | 512.29 | 43 | 2500 |
| 5 | 19.3 | 861.95 | 911.47 | 43 | 2500 |
| 6 | 19.3 | 861.95 | 1048.53 | 43 | 2500 |
| 7 | 19.3 | 859.42 | 792.37 | 43 | 2500 |
| 8 | 19.3 | 859.42 | 906.41 | 43 | 2500 |
| 9 | 19.3 | 859.42 | 1043.47 | 43 | 2500 |
| 10 | 18.1 | 493.751 | 595.34 | 27 | 2500 |
| 11 | 18.1 | 493.751 | 742.38 | 27 | 2500 |
| 12 | 18.1 | 493.751 | 839.43 | 27 | 2500 |
| 13 | 19.8 | 485.757 | 595.34 | 26 | 2500 |
| 14 | 19.8 | 485.757 | 726.39 | 26 | 2500 |
| 15 | 19.8 | 485.757 | 823.44 | 26 | 2500 |
| 16 | 15 | 791.87 | 698.84 | 40 | 2500 |
| 17 | 15 | 791.87 | 630.28 | 40 | 2500 |
| 18 | 15 | 791.87 | 814.41 | 40 | 2500 |
| 19 | 19.1 | 804.96 | 997.54 | 40 | 5000 |
| 20 | 19.1 | 804.96 | 813.42 | 40 | 5000 |
| 21 | 19.1 | 804.96 | 926.51 | 40 | 5000 |
| 22 | 16.6 | 674.67 | 660.36 | 38 | 2500 |
| 23 | 16.6 | 674.67 | 823.42 | 38 | 2500 |
| 24 | 16.6 | 674.67 | 952.46 | 38 | 2500 |
| 25 | 14.6 | 638.34 | 746.42 | 33 | 2500 |
| 26 | 14.6 | 638.34 | 972.51 | 33 | 2500 |
| 27 | 14.6 | 638.34 | 460.73 | 33 | 2500 |
| 28 | 15.9 | 885.44 | 866.37 | 44 | 2500 |
| 29 | 15.9 | 885.44 | 923.39 | 44 | 2500 |
| 30 | 15.9 | 885.44 | 980.41 | 44 | 2500 |
| 31 | 17 | 877.44 | 722.31 | 44 | 2500 |
| 32 | 17 | 877.44 | 907.39 | 44 | 2500 |
| 33 | 17 | 877.44 | 964.42 | 44 | 2500 |
| 34 | 19.5 | 676.32 | 630.28 | 38 | 2500 |
| 35 | 19.5 | 676.32 | 743.37 | 38 | 2500 |
| 36 | 19.5 | 676.32 | 814.41 | 38 | 2500 |
| 37 | 18.6 | 623.35 | 691.38 | 32 | 2500 |
| 38 | 18.6 | 623.35 | 804.46 | 32 | 2500 |
| 39 | 18.6 | 623.35 | 933.51 | 32 | 2500 |
| 40 | 1.3 | 317.15 | 418.2 | 19 | 6000 |
| 41 | 1.3 | 317.15 | 489.24 | 19 | 6000 |
| 42 | 1.3 | 317.15 | 546.26 | 19 | 6000 |
| 43 | 1 | 296.64 | 391.19 | 18 | 2500 |
| 44 | 1 | 296.64 | 448.22 | 18 | 2500 |
| 45 | 1 | 296.64 | 505.24 | 18 | 2500 |
| 46 | 10.5 | 565.78 | 845.41 | 30 | 2500 |
| 47 | 10.6 | 565.78 | 916.45 | 30 | 2500 |
| 48 | 10.6 | 565.78 | 1031.48 | 30 | 2500 |
| 49 | 4.1 | 393.72 | 462.22 | 22 | 2500 |
| 50 | 4.1 | 393.72 | 559.27 | 22 | 2500 |
| 51 | 4.1 | 393.72 | 687.37 | 22 | 2500 |
| 52 | 20.1 | 855.92 | 698.36 | 43 | 2500 |
| 53 | 20.1 | 855.92 | 629.33 | 43 | 2500 |
| 54 | 20.1 | 855.92 | 813.44 | 43 | 2500 |
| 55 | 17 | 585.26 | 705.36 | 31 | 4000 |
| 56 | 17 | 585.26 | 852.4 | 31 | 4000 |
| 57 | 16.9 | 585.26 | 953.44 | 31 | 4000 |
| 58 | 13.2 | 569.27 | 689.37 | 30 | 2500 |
| 59 | 13.2 | 569.27 | 820.41 | 30 | 2500 |
| 60 | 13.2 | 569.27 | 921.45 | 30 | 2500 |
| 61 | 18.3 | 870.93 | 749.86 | 43 | 2500 |
| 62 | 18.3 | 870.93 | 512.29 | 43 | 2500 |
| 63 | 18.3 | 870.93 | 929.43 | 43 | 2500 |
| 64 | 14.9 | 763.36 | 630.28 | 39 | 2500 |
| 65 | 14.9 | 763.36 | 814.41 | 39 | 2500 |
| 66 | 14.9 | 763.36 | 943.45 | 39 | 2500 |
| 67 | 14.9 | 510.73 | 776.33 | 27 | 2500 |
| 68 | 14.9 | 510.73 | 873.38 | 27 | 2500 |
| 69 | 14.9 | 510.73 | 437.2 | 27 | 2500 |
| 70 | 18.9 | 494.74 | 744.34 | 27 | 2500 |
| 71 | 18.9 | 494.74 | 841.39 | 27 | 2500 |
| 72 | 18.9 | 494.74 | 421.2 | 27 | 2500 |
| 73 | 15.5 | 676.39 | 756.4 | 35 | 2500 |
| 74 | 15.5 | 676.39 | 813.42 | 35 | 2500 |
| 75 | 15.5 | 676.39 | 926.51 | 35 | 2500 |
| 76 | 11.5 | 543.78 | 787.41 | 29 | 2500 |
| 77 | 11.5 | 543.78 | 858.44 | 29 | 2500 |
| 78 | 11.5 | 543.78 | 973.47 | 29 | 2500 |
| 79 | 12.5 | 608.82 | 803.43 | 32 | 2500 |
| 80 | 12.5 | 608.82 | 966.49 | 32 | 2500 |
| 81 | 12.5 | 608.82 | 552.28 | 32 | 2500 |
| 82 | 15.5 | 990.98 | 934.44 | 49 | 2500 |
| 83 | 15.5 | 990.98 | 573.32 | 49 | 2500 |
| 84 | 15.5 | 990.98 | 660.36 | 49 | 2500 |
| 85 | 19 | 892.44 | 722.31 | 44 | 2500 |
| 86 | 19 | 892.44 | 907.39 | 44 | 2500 |
| 87 | 19 | 892.44 | 964.42 | 44 | 2500 |
| 88 | 19.4 | 700.65 | 630.28 | 39 | 2500 |
| 89 | 19.4 | 700.65 | 743.37 | 39 | 2500 |
| 90 | 19.4 | 700.65 | 814.41 | 39 | 2500 |
| 91 | 10.4 | 467.73 | 587.3 | 26 | 2500 |
| 92 | 10.4 | 467.73 | 700.39 | 26 | 2500 |
| 93 | 10.4 | 467.73 | 787.42 | 26 | 2500 |
| 94 | 12.8 | 459.73 | 587.3 | 25 | 2500 |
| 95 | 12.8 | 459.73 | 700.39 | 25 | 2500 |
| 96 | 12.8 | 459.73 | 787.42 | 25 | 2500 |
| 97 | 20.1 | 688.83 | 593.26 | 35 | 2500 |
| 98 | 20.1 | 688.83 | 779.34 | 35 | 2500 |
| 99 | 20.1 | 688.83 | 894.37 | 35 | 2500 |
| 100 | 1.4 | 303.646 | 391.19 | 18 | 13000 |
| 101 | 1.4 | 303.646 | 462.23 | 18 | 13000 |
| 102 | 1.4 | 303.646 | 519.25 | 18 | 13000 |
| 103 | 31.6 | 851.81 | 619.35 | 47 | 2500 |

TABLE 4-continued

| Transition number | Retention time (minutes) | (m/z) filtered in Q1 | (m/z) filtered in Q3 | Collision energy (eV) | Positivity threshold |
|---|---|---|---|---|---|
| 104 | 31.6 | 851.81 | 686.41 | 47 | 2500 |
| 105 | 31.6 | 851.81 | 894.5 | 47 | 2500 |
| 106 | 18.8 | 654.35 | 746.4 | 34 | 2500 |
| 107 | 18.8 | 654.35 | 875.45 | 34 | 2500 |
| 108 | 18.8 | 654.35 | 988.53 | 34 | 2500 |
| 109 | 16.3 | 559.31 | 632.34 | 30 | 2500 |
| 110 | 16.3 | 559.31 | 792.37 | 30 | 2500 |
| 111 | 16.3 | 559.31 | 905.45 | 30 | 2500 |
| 112 | 10.5 | 487.73 | 544.32 | 26 | 2500 |
| 113 | 10.5 | 487.73 | 659.35 | 26 | 2500 |
| 114 | 10.5 | 487.73 | 788.39 | 26 | 2500 |
| 115 | 12.6 | 690.35 | 779.41 | 35 | 2500 |
| 116 | 12.6 | 690.35 | 947.5 | 35 | 2500 |
| 117 | 12.6 | 690.35 | 474.26 | 35 | 2500 |
| 118 | 15.9 | 682.35 | 763.41 | 35 | 2500 |
| 119 | 15.9 | 682.35 | 931.5 | 35 | 2500 |
| 120 | 15.9 | 682.35 | 466.26 | 35 | 2500 |
| 121 | 19.8 | 486.75 | 728.36 | 26 | 2500 |
| 122 | 19.8 | 486.75 | 825.42 | 26 | 2500 |
| 123 | 19.8 | 486.75 | 413.21 | 26 | 2500 |
| 124 | 18.4 | 478.75 | 712.37 | 26 | 2500 |
| 125 | 18.4 | 478.75 | 809.42 | 26 | 2500 |
| 126 | 18.4 | 478.75 | 405.21 | 26 | 2500 |
| 127 | 16.3 | 776.93 | 756.4 | 39 | 2500 |
| 128 | 16.3 | 776.93 | 813.42 | 39 | 2500 |
| 129 | 16.3 | 776.93 | 926.51 | 39 | 2500 |
| 130 | 12.2 | 523.26 | 579.3 | 28 | 2500 |
| 131 | 12.2 | 523.26 | 795.37 | 28 | 2500 |
| 132 | 12.2 | 523.26 | 908.45 | 28 | 2500 |
| 133 | 12 | 515.26 | 506.28 | 28 | 2500 |
| 134 | 12 | 515.26 | 779.37 | 28 | 2500 |
| 135 | 12 | 515.26 | 892.46 | 28 | 2500 |
| 136 | 18 | 899.46 | 439.33 | 36 | 2500 |
| 137 | 18 | 899.46 | 304.16 | 57 | 2500 |
| 138 | 18 | 899.46 | 994.43 | 36 | 2500 |
| 139 | 15.6 | 681.33 | 661.29 | 38 | 2500 |
| 140 | 15.6 | 681.33 | 808.33 | 38 | 2500 |
| 141 | 15.6 | 681.33 | 909.37 | 38 | 2500 |
| 142 | 16.6 | 676 | 661.29 | 38 | 3100 |
| 143 | 16.6 | 676 | 792.33 | 38 | 3100 |
| 144 | 16.6 | 676 | 893.38 | 38 | 3100 |
| 145 | 17.2 | 688.32 | 630.28 | 38 | 2500 |
| 146 | 17.2 | 688.32 | 729.35 | 38 | 2500 |
| 147 | 17.2 | 688.32 | 800.39 | 38 | 2500 |
| 148 | 27 | 878.12 | 841.5 | 48 | 2500 |
| 149 | 27 | 878.12 | 795.34 | 48 | 2500 |
| 150 | 27 | 878.12 | 910.37 | 48 | 2500 |
| 151 | 27.9 | 872.79 | 462.22 | 48 | 2500 |
| 152 | 27.9 | 872.79 | 779.34 | 48 | 2500 |
| 153 | 27.9 | 872.79 | 894.37 | 48 | 2500 |
| 154 | 18.8 | 571.84 | 701.46 | 30 | 2500 |
| 155 | 18.8 | 571.84 | 830.5 | 30 | 2500 |
| 156 | 18.8 | 571.84 | 901.54 | 30 | 2500 |
| 157 | 16.6 | 565.82 | 701.46 | 30 | 2500 |
| 158 | 16.6 | 565.82 | 830.5 | 30 | 2500 |
| 159 | 16.6 | 565.82 | 901.54 | 30 | 2500 |
| 160 | 1.5 | 317.64 | 419.19 | 19 | 9000 |
| 161 | 1.5 | 317.64 | 490.23 | 19 | 9000 |
| 162 | 1.5 | 317.64 | 547.25 | 19 | 9000 |
| 163 | 0.9 | 225.12 | 234.14 | 18 | 2500 |
| 164 | 0.9 | 225.12 | 305.18 | 13 | 2500 |
| 165 | 0.9 | 225.12 | 362.2 | 13 | 2500 |
| 166 | 14.1 | 363.24 | 498.34 | 21 | 2500 |
| 167 | 14.1 | 363.24 | 555.36 | 21 | 2500 |
| 168 | 14.1 | 363.24 | 626.4 | 21 | 2500 |
| 169 | 14.7 | 671.32 | 593.28 | 35 | 4500 |
| 170 | 14.7 | 671.32 | 780.36 | 35 | 4500 |
| 171 | 14.7 | 671.32 | 909.4 | 35 | 4500 |
| 172 | 17.5 | 663.32 | 764.36 | 34 | 2500 |
| 173 | 17.5 | 663.32 | 893.4 | 34 | 2500 |
| 174 | 17.5 | 663.32 | 1006.49 | 34 | 2500 |
| 175 | 18 | 856.4 | 698.84 | 43 | 2500 |
| 176 | 18 | 856.4 | 630.28 | 43 | 2500 |
| 177 | 18 | 856.4 | 814.41 | 43 | 2500 |
| 178 | 18.6 | 877.94 | 829.4 | 44 | 2500 |
| 179 | 18.6 | 877.94 | 943.44 | 44 | 2500 |
| 180 | 18.6 | 877.94 | 1080.5 | 44 | 2500 |
| 181 | 18.1 | 493.75 | 742.38 | 27 | 2500 |
| 182 | 18.1 | 493.75 | 839.43 | 27 | 2500 |
| 183 | 18.1 | 493.75 | 420.22 | 27 | 2500 |
| 184 | 19.8 | 485.76 | 726.39 | 26 | 2500 |
| 185 | 19.8 | 485.76 | 823.44 | 26 | 2500 |
| 186 | 19.8 | 485.76 | 412.22 | 26 | 2500 |
| 187 | 16.5 | 828.43 | 756.4 | 41 | 2500 |
| 188 | 16.5 | 828.43 | 813.42 | 41 | 2500 |
| 189 | 16.5 | 828.43 | 926.51 | 41 | 2500 |
| 190 | 16.1 | 791.93 | 756.4 | 40 | 2500 |
| 191 | 16.1 | 791.93 | 813.42 | 40 | 2500 |
| 192 | 16.1 | 791.93 | 926.51 | 40 | 2500 |
| 193 | 15.7 | 559.81 | 676.38 | 30 | 2500 |
| 194 | 14.1 | 559.81 | 763.41 | 30 | 2500 |
| 195 | 14.1 | 559.81 | 892.45 | 30 | 2500 |
| 196 | 16.6 | 676.34 | 646.31 | 38 | 2500 |
| 197 | 16.6 | 676.34 | 793.96 | 38 | 2500 |
| 198 | 16.6 | 676.34 | 894.4 | 38 | 2500 |
| 199 | 18.9 | 671.01 | 646.31 | 38 | 4000 |
| 200 | 18.9 | 671.01 | 777.96 | 38 | 4000 |
| 201 | 18.9 | 671.01 | 878.4 | 38 | 4000 |
| 202 | 16.9 | 892.45 | 722.31 | 44 | 2500 |
| 203 | 16.9 | 892.45 | 937.4 | 44 | 2500 |
| 204 | 16.9 | 892.45 | 994.43 | 44 | 2500 |
| 205 | 17.9 | 707.99 | 630.28 | 39 | 6000 |
| 206 | 17.9 | 707.99 | 743.37 | 39 | 6000 |
| 207 | 17.9 | 707.99 | 814.41 | 39 | 6000 |
| 208 | 22.5 | 643.89 | 660.4 | 33 | 2500 |
| 209 | 22.5 | 643.89 | 773.49 | 33 | 2500 |
| 210 | 22.5 | 643.89 | 959.55 | 33 | 2500 |
| 211 | 17.5 | 632.31 | 781.32 | 33 | 3000 |
| 212 | 17.5 | 632.31 | 894.4 | 33 | 3000 |
| 213 | 17.5 | 632.31 | 1007.49 | 33 | 3000 |
| 214 | 19.8 | 624.31 | 765.32 | 32 | 2500 |
| 215 | 19.8 | 624.31 | 878.41 | 32 | 2500 |
| 216 | 19.8 | 624.31 | 991.49 | 32 | 2500 |
| 217 | 21.4 | 638.34 | 836.43 | 33 | 2500 |
| 218 | 21.4 | 638.34 | 1004.52 | 33 | 2500 |
| 219 | 21.5 | 638.34 | 502.76 | 33 | 2500 |
| 220 | 3.2 | 273.65 | 331.21 | 17 | 2500 |
| 221 | 3.2 | 273.65 | 402.25 | 17 | 2500 |
| 222 | 3.2 | 273.65 | 459.27 | 17 | 2500 |
| 223 | 1.3 | 303.65 | 361.18 | 18 | 21000 |
| 224 | 1.3 | 303.65 | 462.23 | 18 | 21000 |
| 225 | 1.3 | 303.65 | 519.25 | 18 | 21000 |
| 226 | 31.3 | 863.138 | 619.35 | 47 | 2500 |
| 227 | 31.3 | 863.138 | 686.41 | 47 | 2500 |
| 228 | 31.3 | 863.138 | 823.47 | 47 | 2500 |
| 229 | 17.7 | 544.32 | 602.36 | 29 | 2500 |
| 230 | 17.7 | 544.32 | 762.39 | 29 | 2500 |
| 231 | 17.7 | 544.32 | 875.48 | 29 | 2500 |
| 232 | 9.8 | 412.21 | 476.27 | 23 | 2500 |
| 233 | 9.8 | 412.21 | 573.32 | 23 | 2500 |
| 234 | 9.8 | 412.21 | 660.36 | 23 | 2500 |
| 235 | 15.2 | 843.38 | 698.84 | 42 | 2500 |
| 236 | 15.2 | 843.38 | 630.28 | 42 | 2500 |
| 237 | 15.2 | 843.38 | 943.45 | 42 | 2500 |
| 238 | 8.7 | 480.72 | 530.3 | 26 | 2500 |
| 239 | 8.7 | 480.72 | 645.33 | 26 | 2500 |
| 240 | 8.7 | 480.72 | 774.37 | 26 | 2500 |
| 241 | 18.8 | 704.35 | 763.41 | 36 | 2500 |
| 242 | 18.8 | 704.35 | 959.53 | 36 | 2500 |
| 243 | 18.8 | 704.35 | 480.27 | 36 | 2500 |
| 244 | 18.3 | 425.25 | 506.31 | 24 | 2500 |
| 245 | 18.3 | 425.25 | 607.36 | 24 | 2500 |
| 246 | 18.3 | 425.25 | 720.44 | 24 | 2500 |
| 247 | 16.4 | 798.94 | 997.54 | 40 | 2500 |
| 248 | 16.3 | 798.94 | 756.4 | 40 | 2500 |
| 249 | 16.3 | 798.94 | 926.51 | 40 | 2500 |
| 250 | 8.3 | 494.26 | 850.45 | 27 | 2500 |
| 251 | 8.3 | 494.26 | 636.31 | 27 | 2500 |
| 252 | 8.3 | 494.26 | 737.36 | 27 | 2500 |
| 253 | 10.9 | 486.26 | 834.45 | 26 | 2500 |
| 254 | 10.9 | 486.26 | 620.32 | 26 | 2500 |
| 255 | 10.9 | 486.26 | 721.37 | 26 | 2500 |

TABLE 4-continued

| Transition number | Retention time (minutes) | (m/z) filtered in Q1 | (m/z) filtered in Q3 | Collision energy (eV) | Positivity threshold |
|---|---|---|---|---|---|
| 256 | 19.3 | 691.67 | 793.36 | 39 | 2500 |
| 257 | 19.3 | 691.67 | 894.4 | 39 | 2500 |
| 258 | 19.3 | 691.67 | 965.44 | 39 | 2500 |
| 259 | 20.6 | 681.01 | 646.31 | 38 | 2500 |
| 260 | 20.6 | 681.01 | 777.36 | 38 | 2500 |
| 261 | 20.6 | 681.01 | 878.4 | 38 | 2500 |
| 262 | 18 | 692.99 | 630.28 | 39 | 2500 |
| 263 | 18 | 692.99 | 743.37 | 39 | 2500 |
| 264 | 18 | 692.99 | 814.41 | 39 | 2500 |
| 265 | 23 | 658.89 | 1090.61 | 34 | 2500 |
| 266 | 23 | 658.89 | 773.49 | 34 | 2500 |
| 267 | 23 | 658.89 | 989.56 | 34 | 2500 |
| 268 | 17.9 | 564.83 | 687.44 | 30 | 2500 |
| 269 | 17.9 | 564.83 | 816.48 | 30 | 2500 |
| 270 | 17.9 | 564.83 | 887.52 | 30 | 2500 |
| 271 | 18.9 | 710.84 | 823.37 | 36 | 2500 |
| 272 | 18.9 | 710.84 | 938.39 | 36 | 2500 |
| 273 | 18.9 | 710.84 | 1051.48 | 36 | 2500 |
| 274 | 20.9 | 702.84 | 621.29 | 36 | 2500 |
| 275 | 20.9 | 702.84 | 807.37 | 36 | 2500 |
| 276 | 20.9 | 702.84 | 922.4 | 36 | 2500 |
| 277 | 22.6 | 652.36 | 559.31 | 34 | 2500 |
| 278 | 22.6 | 652.36 | 1004.52 | 34 | 2500 |
| 279 | 22.6 | 652.36 | 502.76 | 34 | 2500 |
| 280 | 11.1 | 380.21 | 532.29 | 22 | 2500 |
| 281 | 11.1 | 380.21 | 589.31 | 22 | 2500 |
| 282 | 11.1 | 380.21 | 660.35 | 22 | 2500 |
| 283 | 13.1 | 372.22 | 516.3 | 21 | 2500 |
| 284 | 13.1 | 372.22 | 573.32 | 21 | 2500 |
| 285 | 13.1 | 372.22 | 644.35 | 21 | 2500 |
| 286 | 31.3 | 858.47 | 612.34 | 47 | 2500 |
| 287 | 31.3 | 858.47 | 967.1 | 47 | 2500 |
| 288 | 31.3 | 858.47 | 672.39 | 47 | 2500 |
| 289 | 30.5 | 715.73 | 874.95 | 40 | 2500 |
| 290 | 30.5 | 715.73 | 795.45 | 40 | 2500 |
| 291 | 30.6 | 715.73 | 534.79 | 40 | 2500 |
| 292 | 11.7 | 601.79 | 788.39 | 31 | 2500 |
| 293 | 11.7 | 601.79 | 859.43 | 31 | 2500 |
| 294 | 11.7 | 601.79 | 974.45 | 31 | 2500 |
| 295 | 20 | 738.01 | 746.4 | 41 | 2500 |
| 296 | 20 | 738.01 | 875.45 | 41 | 2500 |
| 297 | 20 | 738.01 | 988.53 | 41 | 2500 |
| 298 | 17.6 | 690.34 | 763.61 | 35 | 2500 |
| 299 | 17.6 | 690.34 | 834.45 | 35 | 2500 |
| 300 | 17.6 | 690.34 | 931.5 | 35 | 2500 |
| 301 | 19.5 | 683.34 | 779.41 | 35 | 6000 |
| 302 | 19.5 | 683.34 | 850.45 | 35 | 6000 |
| 303 | 19.5 | 683.34 | 474.25 | 35 | 6000 |
| 304 | 16.1 | 675.34 | 763.41 | 35 | 2500 |
| 305 | 16.1 | 675.34 | 931.5 | 35 | 2500 |
| 306 | 16.1 | 675.34 | 466.25 | 35 | 2500 |
| 307 | 14.4 | 816.94 | 565.31 | 41 | 2500 |
| 308 | 14.4 | 816.94 | 744.92 | 41 | 2500 |
| 309 | 14.4 | 816.94 | 813.42 | 41 | 2500 |
| 310 | 13 | 513.26 | 563.3 | 28 | 2500 |
| 311 | 13 | 513.26 | 775.38 | 28 | 2500 |
| 312 | 13 | 513.26 | 888.46 | 28 | 2500 |
| 313 | 16.6 | 997.99 | 941.45 | 49 | 2500 |
| 314 | 16.6 | 997.99 | 573.32 | 49 | 2500 |
| 315 | 16.6 | 997.99 | 952.46 | 49 | 2500 |
| 316 | 18.9 | 907.44 | 722.32 | 45 | 2500 |
| 317 | 18.9 | 907.44 | 937.4 | 45 | 2500 |
| 318 | 18.9 | 907.44 | 994.43 | 45 | 2500 |
| 319 | 23.7 | 672.89 | 547.32 | 35 | 2500 |
| 320 | 23.7 | 672.89 | 660.4 | 35 | 2500 |
| 321 | 23.7 | 672.89 | 773.49 | 35 | 2500 |
| 322 | 17.1 | 473.21 | 528.29 | 26 | 2500 |
| 323 | 17.9 | 473.21 | 627.32 | 26 | 2500 |
| 324 | 17.8 | 473.21 | 684.34 | 26 | 2500 |
| 325 | 8.4 | 465.22 | 512.29 | 25 | 9000 |
| 326 | 8.4 | 465.22 | 627.32 | 25 | 9000 |
| 327 | 8.4 | 465.22 | 684.34 | 25 | 9000 |
| 328 | 19.8 | 585.86 | 701.46 | 31 | 2500 |
| 329 | 19.8 | 585.86 | 830.5 | 31 | 2500 |
| 330 | 19.8 | 585.86 | 929.57 | 31 | 2500 |
| 331 | 1.3 | 288.64 | 361.18 | 18 | 8000 |
| 332 | 1.3 | 288.64 | 432.22 | 18 | 8000 |
| 333 | 1.3 | 288.64 | 489.24 | 18 | 8000 |
| 334 | 14.5 | 399.25 | 498.34 | 23 | 6000 |
| 335 | 14.5 | 399.25 | 627.38 | 23 | 6000 |
| 336 | 14.5 | 399.25 | 698.42 | 23 | 6000 |
| 337 | 31.3 | 874.47 | 823.47 | 48 | 2500 |
| 338 | 31.3 | 874.47 | 619.41 | 48 | 2500 |
| 339 | 31.3 | 874.47 | 686.41 | 48 | 2500 |
| 340 | 31.3 | 863.14 | 823.47 | 47 | 2500 |
| 341 | 31.3 | 863.14 | 619.34 | 47 | 2500 |
| 342 | 31.3 | 863.14 | 686.41 | 47 | 2500 |
| 343 | 10.6 | 536.77 | 602.38 | 29 | 2500 |
| 344 | 10.6 | 536.77 | 787.41 | 29 | 2500 |
| 345 | 10.6 | 536.77 | 858.44 | 29 | 2500 |
| 346 | 16.5 | 646.33 | 502.26 | 33 | 7000 |
| 347 | 16.5 | 646.33 | 730.37 | 33 | 7000 |
| 348 | 16.5 | 646.33 | 859.42 | 33 | 7000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 40.00 psi |
| Collision gas which induces dissociation: | 9.00 psi |
| Dynamic filling: | activated |
| Declustering potential (DP): | 80.00 V |
| Entry potential before Q0 (EP): | 10.00 V |
| Collision cell exit potential (CXP): | 35 V |
| Total cycle time: | 1.2 sec |
| Detection window: | 90 sec |

The areas obtained for each of the transitions and for each of the microorganisms studied were measured. When the areas of the 3 transitions of the same peptide are greater than or equal to the positivity threshold described in TABLE 4, the detection of the peptide is considered to be positive and is labelled "1" in TABLE 5. When at least one transition comprises an area less than the positivity threshold described in TABLE 4, the corresponding peptide is considered non-detected and is labelled 0 in TABLE 5.

TABLE 5

| Transition number | Sam10 | Sam11 | Sam12 | Sam13 | Sam14 | Sam15 | Sam16 | Sam17 | Sam18 | Sam19 | Sam20 | Sam21 | Sam22 |
|---|---|---|---|---|---|---|---|---|---|---|---|---|---|
| 1-3 | 0 | 0 | 0 | 0 | 0 | 0 | 0 | 0 | 0 | 0 | 0 | 0 | 0 |
| 4-6 | 0 | 0 | 0 | 0 | 0 | 0 | 0 | 0 | 0 | 0 | 0 | 0 | 0 |
| 7-9 | 0 | 0 | 0 | 0 | 0 | 0 | 0 | 0 | 0 | 0 | 0 | 0 | 0 |

TABLE 5-continued

| | | | | | | | | | | | | | |
|---|---|---|---|---|---|---|---|---|---|---|---|---|---|
| 10-12 | 0 | 0 | 0 | 0 | 0 | 0 | 0 | 0 | 0 | 0 | 0 | 0 | 0 |
| 13-15 | 0 | 0 | 0 | 0 | 0 | 0 | 0 | 0 | 0 | 0 | 0 | 0 | 0 |
| 16-18 | 0 | 0 | 0 | 0 | 0 | 0 | 0 | 0 | 0 | 0 | 0 | 0 | 0 |
| 19-21 | 0 | 0 | 0 | 0 | 0 | 0 | 0 | 0 | 0 | 0 | 0 | 0 | 0 |
| 22-24 | 0 | 1 | 0 | 0 | 1 | 0 | 0 | 0 | 0 | 0 | 0 | 1 | 0 |
| 25-27 | 0 | 1 | 0 | 1 | 1 | 0 | 0 | 1 | 1 | 1 | 0 | 1 | 0 |
| 28-30 | 0 | 0 | 0 | 0 | 0 | 0 | 0 | 0 | 0 | 0 | 0 | 0 | 0 |
| 31-33 | 0 | 0 | 0 | 0 | 0 | 0 | 0 | 0 | 0 | 0 | 0 | 0 | 0 |
| 34-36 | 0 | 0 | 0 | 0 | 1 | 0 | 1 | 1 | 1 | 1 | 0 | 1 | 0 |
| 37-39 | 0 | 0 | 0 | 0 | 0 | 0 | 0 | 0 | 0 | 0 | 0 | 0 | 0 |
| 40-42 | 0 | 0 | 0 | 0 | 0 | 0 | 0 | 0 | 0 | 0 | 0 | 0 | 0 |
| 43-45 | 0 | 0 | 0 | 0 | 0 | 0 | 0 | 0 | 0 | 0 | 0 | 0 | 0 |
| 46-48 | 0 | 0 | 0 | 0 | 0 | 0 | 0 | 0 | 0 | 0 | 0 | 0 | 0 |
| 49-51 | 0 | 0 | 0 | 0 | 0 | 0 | 0 | 0 | 0 | 0 | 0 | 0 | 0 |
| 52-54 | 0 | 0 | 0 | 0 | 0 | 0 | 0 | 0 | 0 | 0 | 0 | 0 | 0 |
| 55-57 | 0 | 0 | 0 | 0 | 0 | 0 | 0 | 0 | 0 | 0 | 0 | 0 | 0 |
| 58-60 | 0 | 0 | 0 | 0 | 0 | 0 | 0 | 0 | 0 | 0 | 0 | 0 | 0 |
| 61-63 | 0 | 0 | 0 | 0 | 0 | 0 | 0 | 0 | 0 | 0 | 0 | 0 | 0 |
| 64-66 | 0 | 0 | 0 | 0 | 0 | 0 | 0 | 0 | 0 | 0 | 0 | 0 | 0 |
| 67-69 | 0 | 0 | 0 | 0 | 0 | 0 | 0 | 0 | 0 | 0 | 0 | 0 | 0 |
| 70-72 | 0 | 0 | 0 | 0 | 0 | 0 | 0 | 0 | 0 | 0 | 0 | 0 | 0 |
| 73-75 | 0 | 1 | 1 | 1 | 1 | 1 | 1 | 1 | 1 | 1 | 1 | 1 | 0 |
| 76-78 | 0 | 0 | 0 | 0 | 0 | 0 | 0 | 0 | 0 | 0 | 0 | 0 | 0 |
| 79-81 | 0 | 0 | 0 | 1 | 0 | 0 | 0 | 0 | 1 | 0 | 0 | 0 | 0 |
| 82-84 | 0 | 0 | 0 | 0 | 0 | 0 | 0 | 0 | 0 | 0 | 0 | 0 | 0 |
| 85-87 | 0 | 0 | 0 | 0 | 0 | 0 | 0 | 0 | 0 | 0 | 0 | 0 | 0 |
| 88-90 | 0 | 0 | 0 | 0 | 0 | 0 | 0 | 0 | 0 | 0 | 0 | 0 | 0 |
| 91-93 | 0 | 0 | 0 | 0 | 0 | 0 | 0 | 0 | 0 | 0 | 0 | 0 | 0 |
| 94-96 | 0 | 0 | 0 | 0 | 0 | 0 | 0 | 0 | 0 | 0 | 0 | 0 | 0 |
| 97-99 | 0 | 1 | 1 | 1 | 1 | 1 | 1 | 1 | 1 | 1 | 0 | 1 | 0 |
| 100-102 | 0 | 0 | 0 | 0 | 0 | 0 | 0 | 0 | 0 | 0 | 0 | 0 | 0 |
| 103-105 | 0 | 0 | 0 | 0 | 0 | 0 | 0 | 0 | 0 | 0 | 0 | 0 | 0 |
| 106-108 | 0 | 1 | 1 | 1 | 1 | 1 | 1 | 1 | 1 | 1 | 1 | 1 | 1 |
| 109-111 | 0 | 0 | 0 | 0 | 0 | 0 | 0 | 0 | 0 | 0 | 0 | 0 | 0 |
| 112-114 | 0 | 0 | 0 | 1 | 1 | 0 | 0 | 0 | 1 | 1 | 0 | 0 | 0 |
| 115-117 | 0 | 0 | 0 | 0 | 0 | 0 | 0 | 0 | 0 | 0 | 0 | 0 | 0 |
| 118-120 | 0 | 0 | 0 | 0 | 0 | 0 | 0 | 0 | 0 | 0 | 0 | 0 | 0 |
| 121-123 | 0 | 0 | 0 | 0 | 0 | 0 | 0 | 0 | 0 | 0 | 0 | 0 | 0 |
| 124-126 | 0 | 0 | 0 | 0 | 0 | 0 | 0 | 0 | 0 | 0 | 0 | 0 | 0 |
| 127-129 | 0 | 0 | 0 | 0 | 0 | 0 | 0 | 0 | 0 | 0 | 0 | 0 | 0 |
| 130-132 | 0 | 0 | 0 | 0 | 0 | 0 | 0 | 0 | 0 | 0 | 0 | 0 | 0 |
| 133-135 | 0 | 1 | 0 | 1 | 1 | 0 | 1 | 1 | 1 | 0 | 0 | 1 | 0 |
| 136-138 | 0 | 0 | 0 | 0 | 0 | 0 | 0 | 0 | 0 | 0 | 0 | 0 | 0 |
| 139-141 | 0 | 0 | 0 | 0 | 0 | 0 | 0 | 0 | 0 | 0 | 0 | 0 | 0 |
| 142-144 | 0 | 0 | 0 | 0 | 0 | 0 | 0 | 0 | 0 | 0 | 0 | 0 | 0 |
| 145-147 | 0 | 0 | 0 | 0 | 0 | 0 | 0 | 0 | 0 | 0 | 0 | 0 | 0 |
| 148-150 | 0 | 0 | 0 | 0 | 0 | 0 | 0 | 0 | 0 | 0 | 0 | 0 | 0 |
| 151-153 | 0 | 0 | 0 | 0 | 0 | 0 | 0 | 0 | 0 | 0 | 0 | 0 | 0 |
| 154-156 | 0 | 1 | 1 | 1 | 1 | 1 | 1 | 1 | 1 | 1 | 0 | 1 | 0 |
| 157-159 | 0 | 0 | 0 | 0 | 0 | 0 | 0 | 0 | 0 | 0 | 0 | 0 | 0 |
| 160-162 | 0 | 0 | 0 | 0 | 0 | 0 | 0 | 0 | 0 | 0 | 0 | 0 | 0 |
| 163-165 | 0 | 0 | 0 | 0 | 0 | 0 | 0 | 0 | 0 | 0 | 0 | 0 | 0 |
| 166-168 | 0 | 1 | 1 | 1 | 1 | 1 | 1 | 1 | 1 | 1 | 1 | 1 | 1 |
| 169-171 | 0 | 0 | 0 | 0 | 0 | 0 | 0 | 0 | 0 | 0 | 0 | 0 | 0 |
| 172-174 | 0 | 0 | 0 | 0 | 0 | 0 | 0 | 0 | 0 | 0 | 0 | 0 | 0 |
| 175-177 | 0 | 1 | 0 | 0 | 0 | 0 | 0 | 0 | 0 | 0 | 0 | 0 | 0 |
| 178-180 | 0 | 0 | 0 | 0 | 0 | 0 | 0 | 0 | 0 | 0 | 0 | 0 | 0 |
| 181-183 | 0 | 0 | 0 | 0 | 0 | 0 | 0 | 0 | 0 | 0 | 0 | 0 | 0 |
| 184-186 | 0 | 0 | 0 | 0 | 0 | 0 | 0 | 0 | 0 | 0 | 0 | 0 | 0 |
| 187-189 | 0 | 0 | 0 | 0 | 0 | 0 | 0 | 0 | 0 | 0 | 0 | 0 | 0 |
| 190-192 | 0 | 0 | 0 | 0 | 0 | 0 | 0 | 0 | 0 | 0 | 0 | 0 | 0 |
| 193-195 | 0 | 0 | 0 | 0 | 0 | 0 | 0 | 0 | 0 | 0 | 0 | 0 | 0 |
| 196-198 | 0 | 0 | 0 | 0 | 0 | 0 | 0 | 0 | 0 | 0 | 0 | 0 | 0 |
| 199-201 | 0 | 0 | 0 | 0 | 0 | 0 | 0 | 0 | 0 | 0 | 0 | 0 | 0 |
| 202-204 | 0 | 0 | 0 | 0 | 0 | 0 | 0 | 0 | 0 | 0 | 0 | 0 | 0 |
| 205-207 | 0 | 0 | 0 | 0 | 0 | 0 | 0 | 0 | 0 | 0 | 0 | 0 | 0 |
| 208-210 | 0 | 0 | 1 | 1 | 1 | 1 | 0 | 1 | 1 | 0 | 1 | 1 | 0 |
| 211-213 | 0 | 0 | 0 | 0 | 0 | 0 | 0 | 0 | 0 | 0 | 0 | 0 | 0 |
| 214-216 | 0 | 0 | 0 | 0 | 0 | 0 | 0 | 0 | 0 | 0 | 0 | 0 | 0 |
| 217-219 | 0 | 0 | 0 | 0 | 0 | 0 | 0 | 0 | 0 | 0 | 0 | 0 | 0 |
| 220-222 | 0 | 0 | 0 | 0 | 0 | 0 | 0 | 0 | 0 | 0 | 0 | 0 | 0 |
| 223-225 | 0 | 0 | 0 | 0 | 0 | 0 | 0 | 0 | 0 | 0 | 0 | 0 | 0 |
| 226-228 | 0 | 0 | 0 | 0 | 0 | 0 | 0 | 0 | 0 | 0 | 0 | 0 | 0 |
| 229-231 | 0 | 0 | 0 | 0 | 0 | 0 | 0 | 0 | 0 | 0 | 0 | 0 | 0 |
| 232-234 | 0 | 0 | 1 | 1 | 0 | 1 | 0 | 1 | 1 | 0 | 1 | 0 | 0 |
| 235-237 | 0 | 0 | 0 | 0 | 0 | 0 | 0 | 0 | 0 | 0 | 0 | 0 | 0 |
| 238-240 | 0 | 0 | 0 | 0 | 0 | 0 | 0 | 0 | 0 | 0 | 0 | 0 | 0 |
| 241-243 | 0 | 0 | 0 | 0 | 0 | 0 | 0 | 0 | 0 | 0 | 0 | 0 | 0 |
| 244-246 | 0 | 0 | 0 | 0 | 0 | 0 | 0 | 0 | 0 | 0 | 0 | 0 | 0 |
| 247-249 | 0 | 0 | 0 | 0 | 0 | 0 | 0 | 0 | 0 | 0 | 0 | 0 | 0 |

TABLE 5-continued

| Transition number | | | | | | | | | | | | | |
|---|---|---|---|---|---|---|---|---|---|---|---|---|---|
| 250-252 | 0 | 0 | 0 | 0 | 0 | 0 | 0 | 0 | 0 | 0 | 0 | 0 | 0 |
| 253-255 | 0 | 0 | 0 | 0 | 0 | 0 | 0 | 0 | 0 | 0 | 0 | 0 | 0 |
| 256-258 | 0 | 0 | 0 | 0 | 0 | 0 | 0 | 0 | 0 | 0 | 0 | 0 | 0 |
| 259-261 | 0 | 0 | 0 | 0 | 0 | 0 | 0 | 0 | 0 | 0 | 0 | 0 | 0 |
| 262-264 | 0 | 0 | 0 | 0 | 0 | 1 | 0 | 0 | 0 | 0 | 0 | 0 | 0 |
| 265-267 | 0 | 0 | 0 | 0 | 0 | 0 | 0 | 0 | 0 | 0 | 0 | 0 | 0 |
| 268-270 | 0 | 0 | 0 | 0 | 0 | 0 | 0 | 0 | 0 | 0 | 0 | 0 | 0 |
| 271-273 | 0 | 0 | 0 | 0 | 0 | 0 | 0 | 0 | 0 | 0 | 0 | 0 | 0 |
| 274-276 | 0 | 0 | 0 | 0 | 0 | 0 | 0 | 0 | 0 | 0 | 0 | 0 | 0 |
| 277-279 | 0 | 0 | 0 | 0 | 0 | 0 | 0 | 0 | 0 | 0 | 0 | 0 | 0 |
| 280-282 | 0 | 0 | 0 | 0 | 0 | 0 | 0 | 0 | 0 | 0 | 0 | 0 | 0 |
| 283-285 | 0 | 0 | 0 | 0 | 0 | 0 | 0 | 0 | 0 | 0 | 0 | 0 | 0 |
| 286-288 | 0 | 0 | 0 | 0 | 0 | 0 | 0 | 0 | 0 | 0 | 0 | 0 | 0 |
| 289-291 | 0 | 0 | 0 | 0 | 0 | 0 | 0 | 0 | 0 | 0 | 0 | 0 | 0 |
| 292-294 | 0 | 0 | 0 | 0 | 0 | 0 | 0 | 0 | 0 | 0 | 0 | 0 | 0 |
| 295-297 | 0 | 0 | 0 | 0 | 0 | 0 | 0 | 0 | 0 | 0 | 0 | 0 | 0 |
| 298-300 | 0 | 1 | 0 | 1 | 1 | 0 | 1 | 1 | 1 | 0 | 0 | 1 | 0 |
| 301-303 | 0 | 0 | 0 | 0 | 0 | 0 | 0 | 0 | 0 | 0 | 0 | 0 | 0 |
| 304-306 | 0 | 0 | 0 | 0 | 0 | 0 | 0 | 0 | 0 | 0 | 0 | 0 | 0 |
| 307-309 | 0 | 0 | 0 | 0 | 0 | 0 | 0 | 0 | 0 | 0 | 0 | 0 | 0 |
| 310-312 | 0 | 0 | 0 | 0 | 0 | 0 | 0 | 0 | 0 | 0 | 0 | 0 | 0 |
| 313-315 | 0 | 0 | 0 | 0 | 0 | 0 | 0 | 0 | 0 | 0 | 0 | 0 | 0 |
| 316-318 | 0 | 0 | 0 | 0 | 0 | 0 | 0 | 0 | 0 | 0 | 0 | 0 | 0 |
| 319-321 | 0 | 0 | 0 | 0 | 0 | 0 | 0 | 0 | 0 | 0 | 0 | 0 | 0 |
| 322-324 | 0 | 0 | 0 | 0 | 0 | 0 | 0 | 0 | 0 | 0 | 0 | 0 | 0 |
| 325-327 | 0 | 0 | 0 | 0 | 0 | 0 | 0 | 0 | 0 | 0 | 0 | 0 | 0 |
| 328-330 | 0 | 0 | 0 | 0 | 0 | 0 | 0 | 0 | 0 | 0 | 0 | 0 | 0 |
| 331-333 | 0 | 0 | 0 | 0 | 0 | 0 | 0 | 0 | 0 | 0 | 0 | 0 | 0 |
| 334-336 | 0 | 0 | 0 | 0 | 0 | 0 | 0 | 0 | 0 | 0 | 0 | 0 | 0 |
| 337-339 | 0 | 0 | 0 | 0 | 0 | 0 | 0 | 0 | 0 | 0 | 0 | 0 | 0 |
| 340-342 | 0 | 0 | 0 | 0 | 0 | 0 | 0 | 0 | 0 | 0 | 0 | 0 | 0 |
| 343-345 | 0 | 1 | 1 | 1 | 1 | 1 | 1 | 1 | 1 | 1 | 0 | 1 | 0 |
| 346-348 | 0 | 0 | 0 | 0 | 0 | 0 | 0 | 0 | 0 | 0 | 0 | 0 | 0 |
| TEM peptides | 0 | 11 | 8 | 13 | 13 | 9 | 9 | 12 | 14 | 9 | 5 | 12 | 2 |
| 2b peptides | 0 | 0 | 0 | 0 | 0 | 0 | 0 | 0 | 0 | 0 | 0 | 0 | 0 |
| 2br peptides | 0 | 0 | 0 | 0 | 0 | 0 | 0 | 0 | 0 | 0 | 0 | 0 | 0 |
| 2be peptides | 0 | 0 | 1 | 2 | 1 | 2 | 1 | 2 | 3 | 1 | 1 | 1 | 0 |
| 2ber peptides | 0 | 0 | 0 | 0 | 0 | 0 | 0 | 0 | 0 | 0 | 0 | 0 | 0 |

| Transition number | Sam23 | Sam24 | Sam25 | Sam26 | Sam27 | Sam28 | Sam29 | Sam30 | Sam31 | Sam32 | Sam33 | Sam34 | Sam35 |
|---|---|---|---|---|---|---|---|---|---|---|---|---|---|
| 1-3 | 0 | 0 | 0 | 0 | 0 | 0 | 0 | 0 | 0 | 0 | 0 | 0 | 0 |
| 4-6 | 0 | 0 | 0 | 0 | 0 | 0 | 0 | 0 | 0 | 0 | 0 | 0 | 0 |
| 7-9 | 0 | 0 | 0 | 0 | 0 | 0 | 0 | 0 | 0 | 0 | 0 | 0 | 0 |
| 10-12 | 0 | 0 | 0 | 0 | 0 | 0 | 0 | 0 | 0 | 0 | 0 | 0 | 0 |
| 13-15 | 0 | 0 | 0 | 0 | 0 | 0 | 0 | 0 | 0 | 0 | 0 | 0 | 0 |
| 16-18 | 0 | 0 | 0 | 0 | 0 | 0 | 0 | 0 | 0 | 0 | 0 | 0 | 0 |
| 19-21 | 0 | 0 | 0 | 0 | 0 | 0 | 0 | 0 | 0 | 0 | 0 | 0 | 0 |
| 22-24 | 0 | 0 | 0 | 0 | 0 | 0 | 0 | 0 | 0 | 0 | 0 | 1 | 1 |
| 25-27 | 1 | 1 | 0 | 1 | 1 | 0 | 0 | 0 | 0 | 0 | 0 | 1 | 1 |
| 28-30 | 0 | 0 | 0 | 0 | 0 | 0 | 0 | 0 | 0 | 0 | 0 | 0 | 0 |
| 31-33 | 0 | 0 | 0 | 0 | 0 | 0 | 0 | 0 | 0 | 0 | 0 | 0 | 0 |
| 34-36 | 1 | 0 | 0 | 0 | 0 | 0 | 0 | 0 | 0 | 0 | 1 | 0 | 0 |
| 37-39 | 0 | 0 | 0 | 0 | 0 | 0 | 0 | 0 | 0 | 0 | 0 | 0 | 0 |
| 40-42 | 0 | 0 | 0 | 0 | 0 | 0 | 0 | 0 | 0 | 0 | 0 | 0 | 0 |
| 43-45 | 0 | 0 | 0 | 0 | 0 | 0 | 0 | 0 | 0 | 0 | 0 | 0 | 0 |
| 46-48 | 0 | 0 | 0 | 0 | 0 | 0 | 0 | 0 | 0 | 0 | 0 | 0 | 0 |
| 49-51 | 0 | 0 | 0 | 0 | 0 | 0 | 0 | 0 | 0 | 0 | 0 | 0 | 0 |
| 52-54 | 0 | 0 | 0 | 0 | 0 | 0 | 0 | 0 | 0 | 0 | 0 | 0 | 0 |
| 55-57 | 0 | 0 | 0 | 0 | 0 | 0 | 0 | 0 | 0 | 0 | 0 | 0 | 0 |
| 58-60 | 0 | 0 | 0 | 0 | 0 | 0 | 0 | 0 | 0 | 0 | 0 | 0 | 0 |
| 61-63 | 0 | 0 | 0 | 0 | 0 | 0 | 0 | 0 | 0 | 0 | 0 | 0 | 0 |
| 64-66 | 0 | 0 | 0 | 0 | 0 | 0 | 0 | 0 | 0 | 0 | 0 | 0 | 0 |
| 67-69 | 0 | 0 | 0 | 0 | 0 | 0 | 0 | 0 | 0 | 0 | 0 | 0 | 0 |
| 70-72 | 0 | 0 | 0 | 0 | 0 | 0 | 0 | 0 | 0 | 0 | 0 | 0 | 0 |
| 73-75 | 1 | 1 | 1 | 1 | 1 | 0 | 1 | 1 | 1 | 1 | 1 | 0 | 0 |
| 76-78 | 0 | 0 | 0 | 0 | 0 | 0 | 0 | 0 | 0 | 0 | 0 | 0 | 0 |
| 79-81 | 0 | 1 | 0 | 1 | 1 | 0 | 0 | 0 | 0 | 1 | 0 | 0 | 0 |
| 82-84 | 0 | 0 | 0 | 0 | 0 | 0 | 0 | 0 | 0 | 0 | 0 | 0 | 0 |
| 85-87 | 0 | 0 | 0 | 0 | 0 | 0 | 0 | 0 | 0 | 0 | 0 | 0 | 0 |
| 88-90 | 0 | 0 | 0 | 0 | 0 | 0 | 0 | 0 | 0 | 0 | 0 | 0 | 0 |
| 91-93 | 0 | 0 | 0 | 0 | 0 | 0 | 0 | 0 | 0 | 0 | 0 | 0 | 0 |
| 94-96 | 0 | 0 | 0 | 0 | 0 | 0 | 0 | 0 | 0 | 0 | 0 | 0 | 0 |
| 97-99 | 1 | 1 | 0 | 1 | 1 | 0 | 0 | 1 | 0 | 0 | 0 | 1 | 1 |

TABLE 5-continued

| | | | | | | | | | | | | | |
|---|---|---|---|---|---|---|---|---|---|---|---|---|---|
| 100-102 | 0 | 0 | 0 | 0 | 0 | 0 | 0 | 0 | 0 | 0 | 0 | 0 | 0 |
| 103-105 | 0 | 0 | 0 | 0 | 0 | 0 | 0 | 0 | 0 | 0 | 0 | 0 | 0 |
| 106-108 | 1 | 1 | 1 | 1 | 1 | 0 | 1 | 1 | 1 | 1 | 1 | 1 | 1 |
| 109-111 | 0 | 0 | 0 | 0 | 0 | 0 | 0 | 0 | 0 | 0 | 0 | 0 | 0 |
| 112-114 | 1 | 1 | 0 | 1 | 0 | 0 | 0 | 0 | 0 | 0 | 0 | 1 | 1 |
| 115-117 | 0 | 0 | 0 | 0 | 0 | 0 | 0 | 0 | 0 | 0 | 0 | 0 | 0 |
| 118-120 | 0 | 0 | 0 | 0 | 0 | 0 | 0 | 0 | 0 | 0 | 0 | 0 | 0 |
| 121-123 | 0 | 0 | 0 | 0 | 0 | 0 | 0 | 0 | 0 | 0 | 0 | 0 | 0 |
| 124-126 | 0 | 0 | 0 | 0 | 0 | 0 | 0 | 0 | 0 | 0 | 0 | 0 | 0 |
| 127-129 | 0 | 0 | 0 | 0 | 0 | 0 | 0 | 0 | 0 | 0 | 0 | 0 | 0 |
| 130-132 | 0 | 0 | 0 | 0 | 0 | 0 | 0 | 0 | 0 | 0 | 0 | 0 | 0 |
| 133-135 | 1 | 1 | 0 | 1 | 1 | 0 | 0 | 0 | 0 | 1 | 1 | 1 | 1 |
| 136-138 | 0 | 0 | 0 | 0 | 0 | 0 | 0 | 0 | 0 | 0 | 0 | 0 | 0 |
| 139-141 | 0 | 0 | 0 | 0 | 0 | 0 | 0 | 0 | 0 | 0 | 0 | 0 | 0 |
| 142-144 | 0 | 0 | 0 | 0 | 0 | 0 | 0 | 0 | 0 | 0 | 0 | 0 | 0 |
| 145-147 | 0 | 0 | 0 | 0 | 0 | 0 | 0 | 0 | 0 | 0 | 0 | 0 | 0 |
| 148-150 | 0 | 0 | 0 | 0 | 0 | 0 | 0 | 0 | 0 | 0 | 0 | 0 | 0 |
| 151-153 | 0 | 0 | 0 | 0 | 0 | 0 | 0 | 0 | 0 | 0 | 0 | 0 | 0 |
| 154-156 | 1 | 1 | 0 | 1 | 1 | 0 | 1 | 0 | 0 | 0 | 0 | 1 | 1 |
| 157-159 | 0 | 0 | 0 | 0 | 0 | 0 | 0 | 0 | 0 | 0 | 0 | 0 | 0 |
| 160-162 | 0 | 0 | 0 | 0 | 0 | 0 | 0 | 0 | 0 | 0 | 0 | 0 | 0 |
| 163-165 | 0 | 0 | 0 | 0 | 0 | 0 | 0 | 0 | 0 | 0 | 0 | 0 | 0 |
| 166-168 | 1 | 1 | 1 | 1 | 1 | 1 | 1 | 1 | 1 | 1 | 1 | 1 | 1 |
| 169-171 | 0 | 0 | 0 | 0 | 0 | 0 | 0 | 0 | 0 | 0 | 0 | 0 | 0 |
| 172-174 | 0 | 0 | 0 | 0 | 0 | 0 | 0 | 0 | 0 | 0 | 0 | 0 | 0 |
| 175-177 | 0 | 1 | 0 | 1 | 1 | 0 | 0 | 0 | 0 | 0 | 0 | 1 | 1 |
| 178-180 | 0 | 0 | 0 | 0 | 0 | 0 | 0 | 0 | 0 | 0 | 0 | 0 | 0 |
| 181-183 | 0 | 0 | 0 | 0 | 0 | 0 | 0 | 0 | 0 | 0 | 0 | 0 | 0 |
| 184-186 | 0 | 0 | 0 | 0 | 0 | 0 | 0 | 0 | 0 | 0 | 0 | 0 | 0 |
| 187-189 | 0 | 0 | 0 | 0 | 0 | 0 | 0 | 0 | 0 | 0 | 0 | 0 | 1 |
| 190-192 | 0 | 0 | 0 | 0 | 0 | 0 | 0 | 0 | 0 | 0 | 0 | 1 | 0 |
| 193-195 | 0 | 0 | 0 | 0 | 0 | 0 | 0 | 0 | 0 | 0 | 0 | 0 | 0 |
| 196-198 | 0 | 0 | 0 | 0 | 0 | 0 | 0 | 0 | 0 | 0 | 0 | 0 | 0 |
| 199-201 | 0 | 0 | 0 | 0 | 0 | 0 | 0 | 0 | 0 | 0 | 0 | 0 | 0 |
| 202-204 | 0 | 0 | 0 | 0 | 0 | 0 | 0 | 0 | 0 | 0 | 0 | 0 | 0 |
| 205-207 | 0 | 0 | 0 | 0 | 0 | 0 | 0 | 0 | 0 | 0 | 0 | 0 | 0 |
| 208-210 | 1 | 1 | 1 | 1 | 0 | 1 | 0 | 0 | 0 | 1 | 1 | 1 | 1 |
| 211-213 | 0 | 0 | 0 | 0 | 0 | 0 | 0 | 0 | 0 | 0 | 0 | 0 | 0 |
| 214-216 | 0 | 0 | 0 | 0 | 0 | 0 | 0 | 0 | 0 | 0 | 0 | 0 | 0 |
| 217-219 | 0 | 0 | 0 | 0 | 0 | 0 | 0 | 0 | 0 | 0 | 0 | 0 | 0 |
| 220-222 | 0 | 0 | 0 | 0 | 0 | 0 | 0 | 0 | 0 | 0 | 0 | 0 | 0 |
| 223-225 | 0 | 0 | 0 | 0 | 0 | 0 | 0 | 0 | 0 | 0 | 0 | 0 | 0 |
| 226-228 | 0 | 0 | 0 | 0 | 0 | 0 | 0 | 0 | 0 | 0 | 0 | 0 | 0 |
| 229-231 | 0 | 0 | 0 | 0 | 0 | 0 | 0 | 0 | 0 | 0 | 0 | 0 | 0 |
| 232-234 | 0 | 1 | 1 | 1 | 1 | 0 | 1 | 0 | 0 | 1 | 0 | 0 | 0 |
| 235-237 | 0 | 0 | 0 | 0 | 0 | 0 | 0 | 0 | 0 | 0 | 0 | 0 | 0 |
| 238-240 | 0 | 0 | 0 | 0 | 0 | 0 | 0 | 0 | 0 | 0 | 0 | 0 | 0 |
| 241-243 | 0 | 0 | 0 | 0 | 0 | 0 | 0 | 0 | 0 | 0 | 0 | 0 | 0 |
| 244-246 | 0 | 0 | 0 | 0 | 0 | 0 | 0 | 0 | 0 | 0 | 0 | 0 | 0 |
| 247-249 | 0 | 0 | 0 | 0 | 0 | 0 | 0 | 0 | 0 | 0 | 0 | 0 | 0 |
| 250-252 | 0 | 0 | 0 | 0 | 0 | 0 | 0 | 0 | 0 | 0 | 0 | 0 | 0 |
| 253-255 | 0 | 0 | 0 | 0 | 0 | 0 | 0 | 0 | 0 | 0 | 0 | 0 | 0 |
| 256-258 | 0 | 0 | 0 | 0 | 0 | 0 | 0 | 0 | 0 | 0 | 0 | 0 | 0 |
| 259-261 | 0 | 0 | 0 | 0 | 0 | 0 | 0 | 0 | 0 | 0 | 0 | 0 | 0 |
| 262-264 | 0 | 0 | 0 | 0 | 0 | 0 | 0 | 0 | 0 | 0 | 1 | 0 | 0 |
| 265-267 | 0 | 0 | 0 | 0 | 0 | 0 | 0 | 0 | 0 | 0 | 0 | 0 | 0 |
| 268-270 | 0 | 0 | 0 | 0 | 0 | 0 | 0 | 0 | 0 | 0 | 0 | 0 | 0 |
| 271-273 | 0 | 0 | 0 | 0 | 0 | 0 | 0 | 0 | 0 | 0 | 0 | 0 | 0 |
| 274-276 | 0 | 0 | 0 | 0 | 0 | 0 | 0 | 0 | 0 | 0 | 0 | 0 | 0 |
| 277-279 | 0 | 0 | 0 | 0 | 0 | 0 | 0 | 0 | 0 | 0 | 0 | 0 | 0 |
| 280-282 | 0 | 0 | 0 | 0 | 0 | 0 | 0 | 0 | 0 | 0 | 0 | 0 | 0 |
| 283-285 | 0 | 0 | 0 | 0 | 0 | 0 | 0 | 0 | 0 | 0 | 0 | 0 | 0 |
| 286-288 | 0 | 0 | 0 | 0 | 0 | 0 | 0 | 0 | 0 | 0 | 0 | 0 | 0 |
| 289-291 | 0 | 0 | 0 | 0 | 0 | 0 | 0 | 0 | 0 | 0 | 0 | 0 | 0 |
| 292-294 | 0 | 0 | 0 | 0 | 0 | 0 | 0 | 0 | 0 | 0 | 0 | 0 | 0 |
| 295-297 | 0 | 0 | 0 | 0 | 0 | 0 | 0 | 0 | 0 | 0 | 0 | 0 | 0 |
| 298-300 | 1 | 1 | 0 | 0 | 0 | 0 | 0 | 1 | 0 | 0 | 0 | 0 | 0 |
| 301-303 | 0 | 0 | 0 | 0 | 0 | 0 | 0 | 0 | 0 | 0 | 0 | 0 | 0 |
| 304-306 | 0 | 0 | 0 | 0 | 0 | 0 | 0 | 0 | 0 | 0 | 0 | 0 | 0 |
| 307-309 | 0 | 0 | 0 | 0 | 0 | 0 | 0 | 0 | 0 | 0 | 0 | 0 | 0 |
| 310-312 | 0 | 0 | 0 | 0 | 0 | 0 | 0 | 0 | 0 | 0 | 0 | 0 | 0 |
| 313-315 | 0 | 0 | 0 | 0 | 0 | 0 | 0 | 0 | 0 | 0 | 0 | 0 | 0 |
| 316-318 | 0 | 0 | 0 | 0 | 0 | 0 | 0 | 0 | 0 | 0 | 0 | 0 | 0 |
| 319-321 | 0 | 0 | 0 | 0 | 0 | 0 | 0 | 0 | 0 | 0 | 0 | 0 | 0 |
| 322-324 | 0 | 0 | 0 | 0 | 0 | 0 | 0 | 0 | 0 | 0 | 0 | 0 | 0 |
| 325-327 | 0 | 0 | 0 | 0 | 0 | 0 | 0 | 0 | 0 | 0 | 0 | 0 | 0 |
| 328-330 | 0 | 0 | 0 | 0 | 0 | 0 | 0 | 0 | 0 | 0 | 0 | 0 | 0 |
| 331-333 | 0 | 0 | 0 | 0 | 0 | 0 | 0 | 0 | 0 | 0 | 0 | 0 | 0 |
| 334-336 | 0 | 0 | 0 | 0 | 0 | 0 | 0 | 0 | 0 | 0 | 0 | 0 | 0 |
| 337-339 | 0 | 0 | 0 | 0 | 0 | 0 | 0 | 0 | 0 | 0 | 0 | 0 | 0 |

TABLE 5-continued

| | | | | | | | | | | | | | |
|---|---|---|---|---|---|---|---|---|---|---|---|---|---|
| 340-342 | 0 | 0 | 0 | 0 | 0 | 0 | 0 | 0 | 0 | 0 | 0 | 0 | 0 |
| 343-345 | 1 | 1 | 1 | 1 | 1 | 0 | 1 | 1 | 0 | 1 | 1 | 1 | 1 |
| 346-348 | 0 | 0 | 0 | 0 | 0 | 0 | 0 | 0 | 0 | 0 | 0 | 0 | 0 |
| TEM peptides | 12 | 14 | 6 | 13 | 11 | 2 | 6 | 6 | 3 | 9 | 7 | 12 | 12 |
| 2b peptides | 0 | 0 | 0 | 0 | 0 | 0 | 0 | 0 | 0 | 0 | 0 | 0 | 0 |
| 2br peptides | 0 | 0 | 0 | 0 | 0 | 0 | 0 | 0 | 0 | 0 | 0 | 0 | 1 |
| 2be peptides | 1 | 2 | 1 | 2 | 2 | 0 | 1 | 0 | 0 | 3 | 1 | 0 | 0 |
| 2ber peptides | 0 | 0 | 0 | 0 | 0 | 0 | 0 | 0 | 0 | 0 | 0 | 0 | 0 |

| Transition number | Sam36 | Sam37 | Sam38 | Sam39 | Sam40 | Sam41 | Sam42 | Sam43 | Sam44 | Sam45 | Sam46 | Sam47 | Sam48 |
|---|---|---|---|---|---|---|---|---|---|---|---|---|---|
| 1-3 | 0 | 0 | 0 | 0 | 0 | 0 | 0 | 0 | 0 | 0 | 0 | 0 | 0 |
| 4-6 | 0 | 0 | 0 | 0 | 0 | 0 | 0 | 0 | 0 | 0 | 0 | 0 | 0 |
| 7-9 | 0 | 0 | 0 | 0 | 0 | 0 | 0 | 0 | 0 | 0 | 0 | 0 | 0 |
| 10-12 | 0 | 0 | 0 | 0 | 0 | 0 | 0 | 0 | 0 | 0 | 0 | 0 | 0 |
| 13-15 | 0 | 0 | 0 | 0 | 0 | 0 | 0 | 0 | 0 | 0 | 0 | 0 | 0 |
| 16-18 | 0 | 0 | 0 | 0 | 0 | 0 | 0 | 0 | 0 | 0 | 0 | 0 | 0 |
| 19-21 | 0 | 0 | 0 | 0 | 0 | 0 | 0 | 0 | 0 | 0 | 0 | 0 | 0 |
| 22-24 | 0 | 0 | 1 | 1 | 0 | 1 | 0 | 0 | 0 | 0 | 0 | 0 | 0 |
| 25-27 | 1 | 0 | 1 | 1 | 1 | 1 | 1 | 0 | 0 | 0 | 1 | 0 | 0 |
| 28-30 | 0 | 0 | 0 | 0 | 0 | 0 | 0 | 0 | 0 | 0 | 0 | 0 | 0 |
| 31-33 | 0 | 0 | 0 | 0 | 0 | 0 | 0 | 0 | 0 | 0 | 0 | 0 | 0 |
| 34-36 | 0 | 0 | 0 | 0 | 0 | 0 | 0 | 0 | 0 | 0 | 0 | 0 | 0 |
| 37-39 | 0 | 0 | 0 | 0 | 0 | 0 | 0 | 0 | 0 | 0 | 0 | 0 | 0 |
| 40-42 | 0 | 0 | 0 | 0 | 0 | 0 | 0 | 0 | 0 | 0 | 0 | 0 | 0 |
| 43-45 | 0 | 0 | 0 | 0 | 0 | 0 | 0 | 0 | 0 | 0 | 0 | 0 | 0 |
| 46-48 | 0 | 0 | 0 | 0 | 0 | 0 | 0 | 0 | 0 | 0 | 0 | 0 | 0 |
| 49-51 | 0 | 0 | 0 | 0 | 0 | 0 | 0 | 0 | 0 | 0 | 0 | 0 | 0 |
| 52-54 | 0 | 0 | 0 | 0 | 0 | 0 | 0 | 0 | 0 | 0 | 0 | 0 | 0 |
| 55-57 | 0 | 0 | 0 | 0 | 0 | 0 | 0 | 0 | 0 | 0 | 0 | 0 | 0 |
| 58-60 | 0 | 0 | 0 | 0 | 0 | 0 | 0 | 0 | 0 | 0 | 0 | 0 | 0 |
| 61-63 | 0 | 0 | 0 | 0 | 0 | 0 | 0 | 0 | 0 | 0 | 0 | 0 | 0 |
| 64-66 | 0 | 0 | 0 | 0 | 0 | 0 | 1 | 0 | 0 | 0 | 0 | 0 | 0 |
| 67-69 | 0 | 0 | 0 | 0 | 0 | 0 | 0 | 0 | 0 | 0 | 0 | 0 | 0 |
| 70-72 | 0 | 0 | 0 | 0 | 0 | 0 | 0 | 0 | 0 | 0 | 0 | 0 | 0 |
| 73-75 | 1 | 1 | 1 | 1 | 1 | 1 | 1 | 1 | 1 | 1 | 1 | 1 | 1 |
| 76-78 | 0 | 0 | 0 | 0 | 0 | 0 | 0 | 0 | 0 | 0 | 0 | 0 | 0 |
| 79-81 | 0 | 0 | 0 | 0 | 0 | 0 | 0 | 0 | 0 | 0 | 1 | 0 | 0 |
| 82-84 | 0 | 0 | 0 | 0 | 0 | 0 | 0 | 0 | 0 | 0 | 0 | 0 | 0 |
| 85-87 | 0 | 0 | 0 | 0 | 0 | 0 | 0 | 0 | 0 | 0 | 0 | 0 | 0 |
| 88-90 | 0 | 0 | 0 | 0 | 0 | 0 | 0 | 0 | 0 | 0 | 0 | 0 | 0 |
| 91-93 | 0 | 0 | 0 | 0 | 0 | 0 | 0 | 0 | 0 | 0 | 0 | 0 | 0 |
| 94-96 | 0 | 0 | 0 | 0 | 0 | 0 | 0 | 0 | 0 | 0 | 0 | 0 | 0 |
| 97-99 | 1 | 0 | 1 | 1 | 1 | 1 | 1 | 0 | 0 | 0 | 1 | 0 | 0 |
| 100-102 | 0 | 0 | 0 | 0 | 0 | 0 | 0 | 0 | 0 | 0 | 0 | 0 | 0 |
| 103-105 | 0 | 0 | 0 | 0 | 0 | 0 | 0 | 0 | 0 | 0 | 0 | 0 | 0 |
| 106-108 | 1 | 1 | 1 | 1 | 1 | 1 | 1 | 1 | 1 | 1 | 1 | 1 | 1 |
| 109-111 | 0 | 0 | 0 | 0 | 0 | 0 | 0 | 0 | 0 | 0 | 0 | 0 | 0 |
| 112-114 | 1 | 0 | 1 | 1 | 1 | 1 | 1 | 0 | 0 | 0 | 1 | 0 | 0 |
| 115-117 | 0 | 0 | 0 | 0 | 0 | 0 | 0 | 0 | 0 | 0 | 0 | 0 | 0 |
| 118-120 | 0 | 0 | 0 | 0 | 0 | 0 | 0 | 0 | 0 | 0 | 0 | 0 | 0 |
| 121-123 | 0 | 0 | 0 | 0 | 0 | 0 | 0 | 0 | 0 | 0 | 0 | 0 | 0 |
| 124-126 | 0 | 0 | 0 | 0 | 0 | 0 | 0 | 0 | 0 | 0 | 0 | 0 | 0 |
| 127-129 | 0 | 0 | 0 | 0 | 0 | 0 | 0 | 0 | 0 | 0 | 0 | 0 | 0 |
| 130-132 | 0 | 0 | 0 | 0 | 0 | 0 | 0 | 0 | 0 | 0 | 0 | 0 | 0 |
| 133-135 | 1 | 1 | 1 | 1 | 1 | 1 | 1 | 1 | 1 | 0 | 1 | 0 | 0 |
| 136-138 | 0 | 0 | 0 | 0 | 0 | 0 | 0 | 0 | 0 | 0 | 0 | 0 | 0 |
| 139-141 | 0 | 0 | 0 | 0 | 0 | 0 | 0 | 0 | 0 | 0 | 0 | 0 | 0 |
| 142-144 | 0 | 0 | 0 | 0 | 0 | 0 | 0 | 0 | 0 | 0 | 0 | 0 | 0 |
| 145-147 | 0 | 0 | 0 | 0 | 0 | 0 | 0 | 0 | 0 | 0 | 0 | 0 | 0 |
| 148-150 | 0 | 0 | 0 | 0 | 0 | 0 | 0 | 0 | 0 | 0 | 0 | 0 | 0 |
| 151-153 | 0 | 0 | 0 | 0 | 0 | 0 | 0 | 0 | 0 | 0 | 0 | 0 | 0 |
| 154-156 | 1 | 0 | 1 | 1 | 1 | 1 | 1 | 0 | 0 | 0 | 1 | 0 | 0 |
| 157-159 | 0 | 0 | 0 | 0 | 0 | 0 | 0 | 0 | 0 | 0 | 0 | 0 | 0 |
| 160-162 | 0 | 0 | 0 | 0 | 0 | 0 | 0 | 0 | 0 | 0 | 0 | 0 | 0 |
| 163-165 | 0 | 0 | 0 | 0 | 0 | 0 | 0 | 0 | 0 | 0 | 0 | 0 | 0 |
| 166-168 | 1 | 1 | 1 | 1 | 1 | 1 | 1 | 1 | 1 | 1 | 1 | 1 | 0 |
| 169-171 | 0 | 0 | 0 | 0 | 0 | 0 | 0 | 0 | 0 | 0 | 0 | 0 | 0 |
| 172-174 | 0 | 0 | 0 | 0 | 0 | 0 | 0 | 0 | 0 | 0 | 0 | 0 | 0 |
| 175-177 | 1 | 0 | 1 | 1 | 1 | 1 | 0 | 0 | 0 | 1 | 1 | 0 | 0 |
| 178-180 | 0 | 0 | 0 | 0 | 0 | 0 | 0 | 0 | 0 | 0 | 0 | 0 | 0 |
| 181-183 | 0 | 0 | 0 | 0 | 0 | 0 | 0 | 0 | 0 | 0 | 0 | 0 | 0 |
| 184-186 | 0 | 0 | 0 | 0 | 0 | 0 | 0 | 0 | 0 | 0 | 0 | 0 | 0 |
| 187-189 | 0 | 0 | 0 | 0 | 0 | 0 | 0 | 0 | 0 | 0 | 0 | 0 | 0 |

TABLE 5-continued

| | | | | | | | | | | | | | |
|---|---|---|---|---|---|---|---|---|---|---|---|---|---|
| 190-192 | 0 | 0 | 0 | 0 | 0 | 0 | 0 | 0 | 0 | 0 | 0 | 0 | 0 |
| 193-195 | 0 | 0 | 0 | 0 | 0 | 0 | 0 | 0 | 0 | 0 | 0 | 0 | 0 |
| 196-198 | 0 | 0 | 0 | 0 | 0 | 0 | 0 | 0 | 0 | 0 | 0 | 0 | 0 |
| 199-201 | 0 | 0 | 0 | 0 | 0 | 0 | 0 | 0 | 0 | 0 | 0 | 0 | 0 |
| 202-204 | 0 | 0 | 0 | 0 | 0 | 0 | 0 | 0 | 0 | 0 | 0 | 0 | 0 |
| 205-207 | 0 | 0 | 0 | 0 | 0 | 0 | 0 | 0 | 0 | 0 | 0 | 0 | 0 |
| 208-210 | 1 | 1 | 1 | 1 | 1 | 1 | 1 | 1 | 1 | 1 | 1 | 1 | 0 |
| 211-213 | 0 | 0 | 0 | 0 | 0 | 0 | 0 | 0 | 0 | 0 | 0 | 0 | 0 |
| 214-216 | 0 | 0 | 0 | 0 | 0 | 0 | 0 | 0 | 0 | 0 | 0 | 0 | 0 |
| 217-219 | 0 | 0 | 0 | 0 | 0 | 0 | 0 | 0 | 0 | 0 | 0 | 0 | 0 |
| 220-222 | 0 | 0 | 0 | 0 | 0 | 0 | 0 | 0 | 0 | 0 | 0 | 0 | 0 |
| 223-225 | 0 | 0 | 0 | 0 | 0 | 0 | 0 | 0 | 0 | 0 | 0 | 0 | 0 |
| 226-228 | 0 | 0 | 0 | 0 | 0 | 0 | 0 | 0 | 0 | 0 | 0 | 0 | 0 |
| 229-231 | 0 | 0 | 0 | 0 | 0 | 0 | 0 | 0 | 0 | 0 | 0 | 0 | 0 |
| 232-234 | 0 | 0 | 0 | 0 | 0 | 0 | 0 | 0 | 1 | 0 | 1 | 0 | 0 |
| 235-237 | 0 | 0 | 0 | 0 | 0 | 0 | 0 | 0 | 0 | 0 | 0 | 0 | 0 |
| 238-240 | 0 | 0 | 0 | 0 | 0 | 0 | 0 | 0 | 0 | 0 | 0 | 0 | 0 |
| 241-243 | 0 | 0 | 0 | 0 | 0 | 0 | 0 | 0 | 0 | 0 | 0 | 0 | 0 |
| 244-246 | 0 | 0 | 0 | 0 | 0 | 0 | 0 | 0 | 0 | 0 | 0 | 0 | 0 |
| 247-249 | 0 | 0 | 0 | 0 | 0 | 0 | 0 | 0 | 0 | 0 | 0 | 0 | 0 |
| 250-252 | 0 | 0 | 0 | 0 | 0 | 0 | 0 | 0 | 0 | 0 | 0 | 0 | 0 |
| 253-255 | 0 | 0 | 0 | 0 | 0 | 0 | 0 | 0 | 0 | 0 | 0 | 0 | 0 |
| 256-258 | 0 | 0 | 0 | 0 | 0 | 0 | 0 | 0 | 0 | 0 | 0 | 0 | 0 |
| 259-261 | 0 | 0 | 0 | 0 | 0 | 0 | 0 | 0 | 0 | 0 | 0 | 0 | 0 |
| 262-264 | 0 | 0 | 0 | 0 | 0 | 0 | 0 | 0 | 0 | 0 | 0 | 0 | 0 |
| 265-267 | 0 | 0 | 0 | 0 | 0 | 0 | 0 | 0 | 0 | 0 | 0 | 0 | 0 |
| 268-270 | 0 | 0 | 0 | 0 | 0 | 0 | 0 | 0 | 0 | 0 | 0 | 0 | 0 |
| 271-273 | 0 | 0 | 0 | 0 | 0 | 0 | 0 | 0 | 0 | 0 | 0 | 0 | 0 |
| 274-276 | 0 | 0 | 0 | 0 | 0 | 0 | 0 | 0 | 0 | 0 | 0 | 0 | 0 |
| 277-279 | 0 | 0 | 0 | 0 | 0 | 0 | 0 | 0 | 0 | 0 | 0 | 0 | 0 |
| 280-282 | 0 | 0 | 0 | 0 | 0 | 0 | 0 | 0 | 0 | 0 | 0 | 0 | 0 |
| 283-285 | 0 | 0 | 0 | 0 | 0 | 0 | 0 | 0 | 0 | 0 | 0 | 0 | 0 |
| 286-288 | 0 | 0 | 0 | 0 | 0 | 0 | 0 | 0 | 0 | 0 | 0 | 0 | 0 |
| 289-291 | 0 | 0 | 0 | 0 | 0 | 0 | 0 | 0 | 0 | 0 | 0 | 0 | 0 |
| 292-294 | 0 | 0 | 0 | 0 | 0 | 0 | 0 | 0 | 0 | 0 | 0 | 0 | 0 |
| 295-297 | 0 | 0 | 0 | 0 | 0 | 0 | 0 | 0 | 0 | 0 | 0 | 0 | 0 |
| 298-300 | 1 | 0 | 1 | 1 | 0 | 1 | 1 | 0 | 0 | 0 | 0 | 0 | 0 |
| 301-303 | 0 | 0 | 0 | 0 | 0 | 0 | 0 | 0 | 0 | 0 | 0 | 0 | 0 |
| 304-306 | 0 | 0 | 0 | 0 | 0 | 0 | 0 | 0 | 0 | 0 | 1 | 0 | 0 |
| 307-309 | 0 | 0 | 0 | 0 | 0 | 0 | 0 | 0 | 0 | 0 | 0 | 0 | 0 |
| 310-312 | 0 | 0 | 0 | 0 | 0 | 0 | 0 | 0 | 0 | 0 | 0 | 0 | 0 |
| 313-315 | 0 | 0 | 0 | 0 | 0 | 0 | 0 | 0 | 0 | 0 | 0 | 0 | 0 |
| 316-318 | 0 | 0 | 0 | 0 | 0 | 0 | 0 | 0 | 0 | 0 | 0 | 0 | 0 |
| 319-321 | 0 | 0 | 0 | 0 | 0 | 0 | 0 | 0 | 0 | 0 | 0 | 0 | 0 |
| 322-324 | 0 | 0 | 0 | 0 | 0 | 0 | 0 | 0 | 0 | 0 | 0 | 0 | 0 |
| 325-327 | 0 | 0 | 0 | 0 | 0 | 0 | 0 | 0 | 0 | 0 | 0 | 0 | 0 |
| 328-330 | 0 | 0 | 0 | 0 | 0 | 0 | 0 | 0 | 0 | 0 | 0 | 0 | 0 |
| 331-333 | 0 | 0 | 0 | 0 | 0 | 0 | 0 | 0 | 0 | 0 | 0 | 0 | 0 |
| 334-336 | 0 | 0 | 0 | 0 | 0 | 0 | 0 | 0 | 0 | 0 | 0 | 0 | 0 |
| 337-339 | 0 | 0 | 0 | 0 | 0 | 0 | 0 | 0 | 0 | 0 | 0 | 0 | 0 |
| 340-342 | 0 | 0 | 0 | 0 | 0 | 0 | 0 | 0 | 0 | 0 | 0 | 0 | 0 |
| 343-345 | 1 | 1 | 1 | 1 | 1 | 1 | 1 | 1 | 1 | 1 | 1 | 1 | 0 |
| 346-348 | 0 | 0 | 0 | 0 | 0 | 0 | 0 | 0 | 0 | 0 | 0 | 0 | 0 |
| TEM peptides | 12 | 6 | 13 | 13 | 11 | 13 | 12 | 6 | 7 | 6 | 14 | 5 | 2 |
| 2b peptides | 0 | 0 | 0 | 0 | 0 | 0 | 0 | 0 | 0 | 0 | 0 | 0 | 0 |
| 2br peptides | 0 | 0 | 0 | 0 | 0 | 0 | 0 | 0 | 0 | 0 | 0 | 0 | 0 |
| 2be peptides | 0 | 0 | 0 | 0 | 0 | 0 | 0 | 0 | 1 | 0 | 2 | 0 | 0 |
| 2ber peptides | 0 | 0 | 0 | 0 | 0 | 0 | 0 | 0 | 0 | 0 | 0 | 0 | 0 |

| Transition number | Sam49 | Sam50 | Sam51 | Sam52 | Sam53 | Sam54 | Sam55 | Sam56 | Sam57 | Sam58 | Sam59 | Sam60 | Sam61 |
|---|---|---|---|---|---|---|---|---|---|---|---|---|---|
| 1-3 | 0 | 0 | 0 | 0 | 0 | 0 | 0 | 0 | 0 | 0 | 0 | 0 | 0 |
| 4-6 | 0 | 0 | 0 | 0 | 0 | 0 | 0 | 0 | 0 | 0 | 0 | 0 | 0 |
| 7-9 | 0 | 0 | 0 | 0 | 0 | 0 | 0 | 0 | 0 | 0 | 0 | 0 | 0 |
| 10-12 | 0 | 0 | 0 | 0 | 0 | 0 | 0 | 0 | 0 | 0 | 0 | 0 | 0 |
| 13-15 | 0 | 0 | 0 | 0 | 0 | 0 | 0 | 0 | 0 | 0 | 0 | 0 | 0 |
| 16-18 | 0 | 0 | 0 | 0 | 0 | 0 | 0 | 0 | 0 | 0 | 0 | 0 | 0 |
| 19-21 | 0 | 0 | 0 | 0 | 0 | 0 | 0 | 0 | 0 | 0 | 0 | 0 | 0 |
| 22-24 | 0 | 0 | 0 | 0 | 1 | 0 | 0 | 1 | 0 | 0 | 0 | 0 | 0 |
| 25-27 | 0 | 1 | 1 | 1 | 1 | 0 | 1 | 1 | 1 | 1 | 1 | 1 | 1 |
| 28-30 | 0 | 0 | 0 | 0 | 0 | 0 | 0 | 0 | 0 | 0 | 0 | 0 | 0 |
| 31-33 | 0 | 0 | 0 | 0 | 0 | 0 | 0 | 0 | 0 | 0 | 0 | 0 | 0 |
| 34-36 | 0 | 0 | 0 | 0 | 0 | 0 | 0 | 0 | 0 | 1 | 1 | 0 | 1 |
| 37-39 | 0 | 0 | 0 | 0 | 0 | 0 | 0 | 0 | 0 | 0 | 0 | 0 | 0 |

TABLE 5-continued

| | | | | | | | | | | | | | |
|---|---|---|---|---|---|---|---|---|---|---|---|---|---|
| 40-42 | 0 | 0 | 0 | 0 | 0 | 0 | 0 | 0 | 0 | 0 | 0 | 0 | 0 |
| 43-45 | 0 | 0 | 0 | 0 | 0 | 0 | 0 | 0 | 0 | 0 | 0 | 0 | 0 |
| 46-48 | 0 | 0 | 0 | 0 | 0 | 0 | 0 | 0 | 0 | 0 | 0 | 0 | 0 |
| 49-51 | 0 | 0 | 0 | 0 | 0 | 0 | 0 | 0 | 0 | 0 | 0 | 0 | 0 |
| 52-54 | 0 | 0 | 0 | 0 | 0 | 0 | 0 | 0 | 0 | 0 | 0 | 0 | 0 |
| 55-57 | 0 | 0 | 0 | 0 | 0 | 0 | 0 | 0 | 0 | 0 | 0 | 0 | 0 |
| 58-60 | 0 | 0 | 0 | 0 | 0 | 0 | 0 | 0 | 0 | 0 | 0 | 0 | 0 |
| 61-63 | 0 | 0 | 0 | 0 | 0 | 0 | 0 | 0 | 0 | 0 | 0 | 0 | 0 |
| 64-66 | 0 | 0 | 0 | 0 | 0 | 0 | 0 | 0 | 0 | 0 | 0 | 0 | 0 |
| 67-69 | 0 | 0 | 0 | 0 | 0 | 0 | 0 | 0 | 0 | 0 | 0 | 0 | 0 |
| 70-72 | 0 | 0 | 0 | 0 | 0 | 0 | 0 | 0 | 0 | 0 | 0 | 0 | 0 |
| 73-75 | 0 | 0 | 0 | 1 | 1 | 0 | 1 | 1 | 1 | 1 | 0 | 1 | 1 |
| 76-78 | 0 | 0 | 0 | 0 | 0 | 0 | 0 | 0 | 0 | 0 | 0 | 0 | 0 |
| 79-81 | 0 | 0 | 0 | 1 | 0 | 0 | 1 | 0 | 1 | 0 | 1 | 0 | 1 |
| 82-84 | 0 | 0 | 0 | 0 | 0 | 0 | 0 | 0 | 0 | 0 | 0 | 0 | 0 |
| 85-87 | 0 | 0 | 0 | 0 | 0 | 0 | 0 | 0 | 0 | 0 | 0 | 0 | 0 |
| 88-90 | 0 | 0 | 0 | 0 | 0 | 0 | 0 | 0 | 0 | 0 | 0 | 0 | 0 |
| 91-93 | 0 | 0 | 0 | 0 | 0 | 0 | 0 | 0 | 0 | 0 | 0 | 0 | 0 |
| 94-96 | 0 | 0 | 0 | 0 | 0 | 0 | 0 | 0 | 0 | 0 | 0 | 0 | 0 |
| 97-99 | 0 | 1 | 0 | 0 | 1 | 0 | 0 | 1 | 1 | 1 | 1 | 0 | 0 |
| 100-102 | 0 | 0 | 0 | 0 | 0 | 0 | 0 | 0 | 0 | 0 | 0 | 0 | 0 |
| 103-105 | 0 | 0 | 0 | 0 | 0 | 0 | 0 | 0 | 0 | 0 | 0 | 0 | 0 |
| 106-108 | 1 | 1 | 1 | 1 | 1 | 0 | 1 | 1 | 1 | 1 | 1 | 1 | 1 |
| 109-111 | 0 | 0 | 0 | 0 | 0 | 0 | 0 | 0 | 0 | 0 | 0 | 0 | 0 |
| 112-114 | 0 | 1 | 1 | 1 | 1 | 0 | 1 | 1 | 0 | 0 | 0 | 0 | 0 |
| 115-117 | 0 | 0 | 0 | 0 | 0 | 0 | 0 | 0 | 0 | 0 | 0 | 0 | 0 |
| 118-120 | 0 | 0 | 0 | 0 | 0 | 0 | 0 | 0 | 0 | 0 | 0 | 0 | 0 |
| 121-123 | 0 | 0 | 0 | 0 | 0 | 0 | 0 | 0 | 0 | 0 | 0 | 0 | 0 |
| 124-126 | 0 | 0 | 0 | 0 | 0 | 0 | 0 | 0 | 0 | 0 | 0 | 0 | 0 |
| 127-129 | 0 | 0 | 0 | 0 | 0 | 0 | 0 | 0 | 0 | 0 | 0 | 0 | 0 |
| 130-132 | 0 | 0 | 0 | 0 | 0 | 0 | 0 | 0 | 0 | 0 | 0 | 0 | 0 |
| 133-135 | 0 | 1 | 0 | 1 | 1 | 0 | 1 | 1 | 1 | 1 | 1 | 1 | 0 |
| 136-138 | 0 | 0 | 0 | 0 | 0 | 0 | 0 | 0 | 0 | 0 | 0 | 0 | 0 |
| 139-141 | 0 | 0 | 0 | 0 | 0 | 0 | 0 | 0 | 0 | 0 | 0 | 0 | 0 |
| 142-144 | 0 | 0 | 0 | 0 | 0 | 0 | 0 | 0 | 0 | 0 | 0 | 0 | 0 |
| 145-147 | 0 | 0 | 0 | 0 | 0 | 0 | 0 | 0 | 0 | 0 | 0 | 0 | 0 |
| 148-150 | 0 | 0 | 0 | 0 | 0 | 0 | 0 | 0 | 0 | 0 | 0 | 0 | 0 |
| 151-153 | 0 | 0 | 0 | 0 | 0 | 0 | 0 | 0 | 0 | 0 | 0 | 0 | 0 |
| 154-156 | 0 | 1 | 0 | 1 | 1 | 0 | 0 | 1 | 1 | 1 | 1 | 1 | 0 |
| 157-159 | 0 | 0 | 0 | 0 | 0 | 0 | 0 | 0 | 0 | 0 | 0 | 0 | 0 |
| 160-162 | 0 | 0 | 0 | 0 | 0 | 0 | 0 | 0 | 0 | 0 | 0 | 0 | 0 |
| 163-165 | 0 | 0 | 0 | 0 | 0 | 0 | 0 | 0 | 0 | 0 | 0 | 0 | 0 |
| 166-168 | 1 | 1 | 1 | 1 | 1 | 0 | 1 | 1 | 1 | 1 | 1 | 1 | 1 |
| 169-171 | 0 | 0 | 0 | 0 | 0 | 0 | 0 | 0 | 0 | 0 | 0 | 0 | 0 |
| 172-174 | 0 | 0 | 0 | 0 | 0 | 0 | 0 | 0 | 0 | 0 | 0 | 0 | 0 |
| 175-177 | 1 | 1 | 1 | 1 | 1 | 0 | 1 | 1 | 1 | 0 | 0 | 1 | 0 |
| 178-180 | 0 | 0 | 0 | 0 | 0 | 0 | 0 | 0 | 0 | 0 | 0 | 0 | 0 |
| 181-183 | 0 | 0 | 0 | 0 | 0 | 0 | 0 | 0 | 0 | 0 | 0 | 0 | 0 |
| 184-186 | 0 | 0 | 0 | 0 | 0 | 0 | 0 | 0 | 0 | 0 | 0 | 0 | 0 |
| 187-189 | 1 | 1 | 0 | 0 | 0 | 0 | 0 | 0 | 0 | 0 | 0 | 0 | 0 |
| 190-192 | 0 | 0 | 1 | 0 | 0 | 0 | 0 | 0 | 0 | 0 | 1 | 0 | 0 |
| 193-195 | 0 | 0 | 0 | 0 | 0 | 0 | 0 | 0 | 0 | 0 | 0 | 0 | 0 |
| 196-198 | 0 | 0 | 0 | 0 | 0 | 0 | 0 | 0 | 0 | 0 | 0 | 0 | 0 |
| 199-201 | 0 | 0 | 0 | 0 | 0 | 0 | 0 | 0 | 0 | 0 | 0 | 0 | 0 |
| 202-204 | 0 | 0 | 0 | 0 | 0 | 0 | 0 | 0 | 0 | 0 | 0 | 0 | 0 |
| 205-207 | 0 | 0 | 0 | 0 | 0 | 0 | 0 | 0 | 0 | 0 | 0 | 0 | 0 |
| 208-210 | 0 | 0 | 0 | 0 | 1 | 0 | 1 | 1 | 0 | 1 | 1 | 1 | 1 |
| 211-213 | 0 | 0 | 0 | 0 | 0 | 0 | 0 | 0 | 0 | 0 | 0 | 0 | 0 |
| 214-216 | 0 | 0 | 0 | 0 | 0 | 0 | 0 | 0 | 0 | 0 | 0 | 0 | 0 |
| 217-219 | 0 | 0 | 0 | 0 | 0 | 0 | 0 | 0 | 0 | 0 | 0 | 0 | 0 |
| 220-222 | 0 | 0 | 0 | 0 | 0 | 0 | 0 | 0 | 0 | 0 | 0 | 0 | 0 |
| 223-225 | 0 | 0 | 0 | 0 | 0 | 0 | 0 | 0 | 0 | 0 | 0 | 0 | 0 |
| 226-228 | 0 | 0 | 0 | 0 | 0 | 0 | 0 | 0 | 0 | 0 | 0 | 0 | 0 |
| 229-231 | 0 | 0 | 0 | 0 | 0 | 0 | 0 | 0 | 0 | 0 | 0 | 0 | 0 |
| 232-234 | 0 | 0 | 0 | 1 | 0 | 0 | 1 | 0 | 1 | 0 | 1 | 0 | 1 |
| 235-237 | 0 | 0 | 0 | 0 | 0 | 0 | 0 | 0 | 0 | 0 | 0 | 0 | 0 |
| 238-240 | 0 | 0 | 0 | 0 | 0 | 0 | 0 | 0 | 0 | 0 | 0 | 0 | 0 |
| 241-243 | 0 | 0 | 0 | 0 | 0 | 0 | 0 | 0 | 0 | 0 | 0 | 0 | 0 |
| 244-246 | 0 | 0 | 0 | 0 | 0 | 0 | 0 | 0 | 0 | 0 | 0 | 0 | 0 |
| 247-249 | 0 | 0 | 0 | 0 | 0 | 0 | 0 | 0 | 0 | 0 | 0 | 0 | 0 |
| 250-252 | 0 | 0 | 0 | 0 | 0 | 0 | 0 | 0 | 0 | 0 | 0 | 0 | 0 |
| 253-255 | 0 | 0 | 0 | 0 | 0 | 0 | 0 | 0 | 0 | 0 | 0 | 0 | 0 |
| 256-258 | 0 | 0 | 0 | 0 | 0 | 0 | 0 | 0 | 0 | 0 | 0 | 0 | 0 |
| 259-261 | 0 | 0 | 0 | 0 | 0 | 0 | 0 | 0 | 0 | 0 | 0 | 0 | 0 |
| 262-264 | 0 | 0 | 0 | 0 | 0 | 0 | 0 | 0 | 0 | 0 | 0 | 0 | 0 |
| 265-267 | 0 | 0 | 0 | 0 | 0 | 0 | 0 | 0 | 0 | 0 | 0 | 0 | 0 |
| 268-270 | 0 | 0 | 0 | 0 | 0 | 0 | 0 | 0 | 0 | 0 | 0 | 0 | 0 |
| 271-273 | 0 | 0 | 0 | 0 | 0 | 0 | 0 | 0 | 0 | 0 | 0 | 0 | 0 |
| 274-276 | 0 | 0 | 0 | 0 | 0 | 0 | 0 | 0 | 0 | 0 | 0 | 0 | 0 |
| 277-279 | 0 | 0 | 0 | 0 | 0 | 0 | 0 | 0 | 0 | 0 | 0 | 0 | 0 |

TABLE 5-continued

| | | | | | | | | | | | | | |
|---|---|---|---|---|---|---|---|---|---|---|---|---|---|
| 280-282 | 0 | 0 | 0 | 0 | 0 | 0 | 0 | 0 | 0 | 0 | 0 | 0 | 0 |
| 283-285 | 0 | 0 | 0 | 0 | 0 | 0 | 0 | 0 | 0 | 0 | 0 | 0 | 0 |
| 286-288 | 0 | 0 | 0 | 0 | 0 | 0 | 0 | 0 | 0 | 0 | 0 | 0 | 0 |
| 289-291 | 0 | 0 | 0 | 0 | 0 | 0 | 0 | 0 | 0 | 0 | 0 | 0 | 0 |
| 292-294 | 0 | 0 | 0 | 0 | 0 | 0 | 0 | 0 | 0 | 0 | 0 | 0 | 0 |
| 295-297 | 0 | 0 | 0 | 0 | 0 | 0 | 0 | 0 | 0 | 0 | 0 | 0 | 0 |
| 298-300 | 0 | 0 | 0 | 0 | 0 | 0 | 1 | 1 | 0 | 0 | 1 | 0 | 0 |
| 301-303 | 0 | 0 | 0 | 0 | 0 | 0 | 0 | 0 | 0 | 0 | 0 | 0 | 0 |
| 304-306 | 0 | 0 | 0 | 1 | 1 | 0 | 0 | 0 | 1 | 0 | 0 | 0 | 0 |
| 307-309 | 0 | 0 | 0 | 0 | 0 | 0 | 0 | 0 | 0 | 0 | 0 | 0 | 0 |
| 310-312 | 0 | 0 | 0 | 0 | 0 | 0 | 0 | 0 | 0 | 0 | 0 | 0 | 0 |
| 313-315 | 0 | 0 | 0 | 0 | 0 | 0 | 0 | 0 | 0 | 0 | 0 | 0 | 0 |
| 316-318 | 0 | 0 | 0 | 0 | 0 | 0 | 0 | 0 | 0 | 0 | 0 | 0 | 0 |
| 319-321 | 0 | 0 | 0 | 0 | 0 | 0 | 0 | 0 | 0 | 0 | 0 | 0 | 0 |
| 322-324 | 0 | 0 | 0 | 0 | 0 | 0 | 0 | 0 | 0 | 0 | 0 | 0 | 0 |
| 325-327 | 0 | 0 | 0 | 0 | 0 | 0 | 0 | 0 | 0 | 0 | 0 | 0 | 0 |
| 328-330 | 0 | 0 | 0 | 0 | 0 | 0 | 0 | 0 | 0 | 0 | 0 | 0 | 0 |
| 331-333 | 0 | 0 | 0 | 0 | 0 | 0 | 0 | 0 | 0 | 0 | 0 | 0 | 0 |
| 334-336 | 0 | 0 | 0 | 0 | 0 | 0 | 0 | 0 | 0 | 0 | 0 | 0 | 0 |
| 337-339 | 0 | 0 | 0 | 0 | 0 | 0 | 0 | 0 | 0 | 0 | 0 | 0 | 0 |
| 340-342 | 0 | 0 | 0 | 0 | 0 | 0 | 0 | 0 | 0 | 0 | 0 | 0 | 0 |
| 343-345 | 1 | 1 | 1 | 1 | 1 | 1 | 1 | 1 | 1 | 1 | 1 | 1 | 1 |
| 346-348 | 0 | 0 | 0 | 0 | 0 | 0 | 0 | 0 | 0 | 0 | 0 | 0 | 0 |
| TEM peptides | 5 | 10 | 7 | 12 | 13 | 1 | 12 | 13 | 12 | 10 | 13 | 9 | 9 |
| 2b peptides | 0 | 0 | 0 | 0 | 0 | 0 | 0 | 0 | 0 | 0 | 0 | 0 | 0 |
| 2br peptides | 1 | 1 | 0 | 0 | 0 | 0 | 0 | 0 | 0 | 0 | 0 | 0 | 0 |
| 2be peptides | 0 | 0 | 0 | 2 | 0 | 0 | 2 | 0 | 2 | 1 | 3 | 2 | 3 |
| 2ber peptides | 0 | 0 | 0 | 0 | 0 | 0 | 0 | 0 | 0 | 0 | 0 | 0 | 0 |

Sample Sam10 does not present any peptide which is characteristic of TEMs. The bacteria present in sample Sam10 may be sensitive to cephalosporins and to penicillins.

Samples Sam11 to Sam61 comprise at least one peptide which is characteristic of TEMs. The bacteria present in samples Sam11 to Sam61 therefore express a beta-lactamase which confers on them a resistance to penicillins.

No peptide specific to phenotype 2b is observed, and no sample tested is identified as being resistant solely to penicillins.

Samples Sam35, Sam49 and Sam50 comprise at least one peptide specific to phenotype 2br. Samples Sam35, Sam49 and Sam50 are therefore resistant to penicillins associated with an inhibitor of the clavulanic acid and tazobactam type.

No peptide specific to phenotype 2ber is observed, and no sample tested is identified as belonging only to this phenotype.

Samples Sam12 to Sam21, Sam23 to Sam27, Sam29, Sam32, Sam33, Sam44, Sam46, Sam52, Sam55 and Sam57 to Sam61 comprise at least one peptide specific to the phenotype 2be or to the phenotype 2ber. Samples Sam12 to Sam21, Sam23 to Sam27, Sam29, Sam32, Sam33, Sam44, Sam46, Sam52, Sam55, and Sam57 to Sam61 are therefore resistant to penicillins, to cephalosporins and to monobactams.

EXAMPLE 7

Identification of a Resistance to CMY Beta-Lactams

The samples corresponding to a species able to comprise a CMY resistance mechanism can be detected by employing the following method.

Each sample is treated according to example 5, then analysed according to example 6 by detecting the peptides from TABLE 6 instead of the peptides from TABLE 3.

TABLE 6

| Transition number | Peptide | Fragment ion | Charge state of the precursor | Retention time | (m/z) filtered in Q1 | (m/z) filtered in Q3 | Collision energy |
|---|---|---|---|---|---|---|---|
| 1 | LSDPVTK | y6 | 2 | 10 | 380.22 | 646.34 | 22 |
| 2 | LSDPVTK | y5 | 2 | 10 | 380.22 | 559.31 | 22 |
| 3 | LSDPVTK | y4 | 2 | 10 | 380.22 | 444.28 | 22 |
| 4 | ADSIINGSDSK | y9 | 2 | 10.2 | 553.77 | 920.47 | 29 |
| 5 | ADSIINGSDSK | y8 | 2 | 10.2 | 553.77 | 833.44 | 29 |
| 6 | ADSIINGSDSK | y7 | 2 | 10.2 | 553.77 | 720.35 | 29 |
| 7 | ASWVHK | y5 | 2 | 11.6 | 364.2 | 656.35 | 21 |

TABLE 6-continued

| Transition number | Peptide | Fragment ion | Charge state of the precursor | Retention time | (m/z) filtered in Q1 | (m/z) filtered in Q3 | Collision energy |
|---|---|---|---|---|---|---|---|
| 8 | ASWVHK | y4 | 2 | 11.6 | 364.2 | 569.32 | 21 |
| 9 | ASWVHK | y3 | 2 | 11.6 | 364.2 | 383.24 | 21 |
| 10 | SYPNPVR | y6 | 2 | 11.6 | 416.72 | 745.4 | 23 |
| 11 | SYPNPVR | y5 | 2 | 11.6 | 416.72 | 582.34 | 23 |
| 12 | SYPNPVR | y4 | 2 | 11.6 | 416.72 | 485.28 | 23 |
| 13 | VEAAWR | y5 | 2 | 12.3 | 366.2 | 632.32 | 21 |
| 14 | VEAAWR | y4 | 2 | 12.3 | 366.2 | 503.27 | 21 |
| 15 | VEAAWR | y3 | 2 | 12.3 | 366.2 | 432.24 | 21 |
| 16 | QWQGIR | y5 | 2 | 13.8 | 394.21 | 659.36 | 22 |
| 17 | QWQGIR | y4 | 2 | 13.8 | 394.21 | 473.28 | 22 |
| 18 | QWQGIR | y3 | 2 | 13.8 | 394.21 | 345.22 | 22 |
| 19 | VLQPLK | y5 | 2 | 14 | 349.23 | 598.39 | 20 |
| 20 | VLQPLK | y4 | 2 | 14 | 349.23 | 485.31 | 20 |
| 21 | VLQPLK | y3 | 2 | 14 | 349.23 | 357.25 | 20 |
| 22 | SSVIDMAR | y7 | 2 | 14.2 | 439.72 | 791.41 | 24 |
| 23 | SSVIDMAR | y6 | 2 | 14.2 | 439.72 | 704.38 | 24 |
| 24 | SSVIDMAR | y5 | 2 | 14.2 | 439.72 | 605.31 | 24 |
| 25 | WVQANMDASHVQEK | y9 | 2 | 14.4 | 821.89 | 1044.48 | 41 |
| 26 | WVQANMDASHVQEK | y8 | 2 | 14.4 | 821.89 | 913.44 | 41 |
| 27 | WVQANMDASHVQEK | y7 | 2 | 14.4 | 821.89 | 798.41 | 41 |
| 28 | TLQQGIALAQSR | y9 | 2 | 15.2 | 643.36 | 943.53 | 33 |
| 29 | TLQQGIALAQSR | y8 | 2 | 15.2 | 643.36 | 815.47 | 33 |
| 30 | TLQQGIALAQSR | y7 | 2 | 15.2 | 643.36 | 758.45 | 33 |
| 31 | TEQQIADIVNR | y9 | 2 | 15.6 | 643.84 | 1056.58 | 33 |
| 32 | TEQQIADIVNR | y8 | 2 | 15.6 | 643.84 | 928.52 | 33 |
| 33 | TEQQIADIVNR | y7 | 2 | 15.6 | 643.84 | 800.46 | 33 |
| 34 | LAHTWITVPQNEQK | y9 | 2 | 16 | 832.94 | 1056.57 | 42 |
| 35 | LAHTWITVPQNEQK | y8 | 2 | 16 | 832.94 | 943.48 | 42 |
| 36 | LAHTWITVPQNEQK | y7 | 2 | 16 | 832.94 | 842.44 | 42 |
| 37 | DYAWGYR | y6 | 2 | 16.4 | 465.71 | 815.38 | 25 |
| 38 | DYAWGYR | y5 | 2 | 16.4 | 465.71 | 652.32 | 25 |
| 39 | DYAWGYR | y4 | 2 | 16.4 | 465.71 | 581.28 | 25 |
| 40 | YWPELTGK | y7 | 2 | 17.4 | 497.26 | 830.44 | 27 |
| 41 | YWPELTGK | y6 | 2 | 17.4 | 497.26 | 644.36 | 27 |
| 42 | YWPELTGK | y5 | 2 | 17.4 | 497.26 | 547.31 | 27 |
| 43 | TFNGVLGGDAIAR | y9 | 2 | 17.6 | 645.84 | 871.5 | 33 |
| 44 | TFNGVLGGDAIAR | y8 | 2 | 17.6 | 645.84 | 772.43 | 33 |
| 45 | TFNGVLGGDAIAR | y7 | 2 | 17.6 | 645.84 | 659.35 | 33 |

TABLE 6-continued

| Transition number | Peptide | Fragment ion | Charge state of the precursor | Retention time | (m/z) filtered in Q1 | (m/z) filtered in Q3 | Collision energy |
|---|---|---|---|---|---|---|---|
| 46 | NLGIVMLANK | y9 | 2 | 19.1 | 536.81 | 958.58 | 29 |
| 47 | NLGIVMLANK | y8 | 2 | 19.1 | 536.81 | 845.49 | 29 |
| 48 | NLGIVMLANK | y7 | 2 | 19.1 | 536.81 | 788.47 | 29 |
| 49 | TGSTGGFGSYVAFVPEK | y9 | 2 | 19.5 | 852.42 | 1039.55 | 43 |
| 50 | TGSTGGFGSYVAFVPEK | y8 | 2 | 19.5 | 852.42 | 952.51 | 43 |
| 51 | TGSTGGFGSYVAFVPEK | y7 | 2 | 19.5 | 852.42 | 789.45 | 43 |
| 52 | ADIANNHPVTQQTLFELGSVSK | y9 | 3 | 20 | 790.41 | 979.55 | 44 |
| 53 | ADIANNHPVTQQTLFELGSVSK | y8 | 3 | 20 | 790.41 | 866.46 | 44 |
| 54 | ADIANNHPVTQQTLFELGSVSK | y7 | 3 | 20 | 790.41 | 719.39 | 44 |
| 55 | VALAALPAVEVNPPAPAVK | y9 | 2 | 20.4 | 914.04 | 892.53 | 45 |
| 56 | VALAALPAVEVNPPAPAVK | y8 | 2 | 20.4 | 914.04 | 793.46 | 45 |
| 57 | VALAALPAVEVNPPAPAVK | y7 | 2 | 20.4 | 914.04 | 679.41 | 45 |
| 58 | LLHLATYTAGGLPLQIPDDVR | y9 | 3 | 22.4 | 755.09 | 1052.57 | 42 |
| 59 | LLHLATYTAGGLPLQIPDDVR | y8 | 3 | 22.4 | 755.09 | 955.52 | 42 |
| 60 | LLHLATYTAGGLPLQIPDDVR | y7 | 3 | 22.4 | 755.09 | 842.44 | 42 |
| 61 | TITPLMQEQAIPGMAVAVIYQGK | y9 | 3 | 22.5 | 820.44 | 948.55 | 45 |
| 62 | TITPLMQEQAIPGMAVAVIYQGK | y8 | 3 | 22.5 | 820.44 | 877.51 | 45 |
| 63 | TITPLMQEQAIPGMAVAVIYQGK | y7 | 3 | 22.5 | 820.44 | 778.45 | 45 |
| 64 | AALLHFYQNWQPQWTPGAK | y9 | 3 | 23.2 | 752.72 | 1012.52 | 42 |
| 65 | AALLHFYQNWQPQWTPGAK | y8 | 3 | 23.2 | 752.72 | 884.46 | 42 |
| 66 | AALLHFYQNWQPQWTPGAK | y7 | 3 | 23.2 | 752.72 | 787.41 | 42 |
| 67 | LYANSSIGLFGALAVK | y9 | 2 | 25.1 | 812.46 | 875.53 | 41 |
| 68 | LYANSSIGLFGALAVK | y8 | 2 | 25.1 | 812.46 | 818.51 | 41 |
| 69 | LYANSSIGLFGALAVK | y7 | 2 | 25.1 | 812.46 | 705.43 | 41 |
| 70 | SLCCALLLTASFSTFAAAK | y9 | 3 | 25.4 | 678.01 | 929.47 | 38 |
| 71 | SLCCALLLTASFSTFAAAK | y8 | 3 | 25.4 | 678.01 | 842.44 | 38 |
| 72 | SLCCALLLTASFSTFAAAK | y7 | 3 | 25.4 | 678.01 | 695.37 | 38 |
| 73 | IGDMYQGLGWEMLNWPLK | y9 | 3 | 28.5 | 717.68 | 1216.62 | 40 |
| 74 | IGDMYQGLGWEMLNWPLK | y8 | 3 | 28.5 | 717.68 | 1030.54 | 40 |
| 75 | IGDMYQGLGWEMLNWPLK | y7 | 3 | 28.5 | 717.68 | 901.5 | 40 |
| 76 | AHYFNYGVANR | y7 | 2 | 15.5 | 656.32 | 793.4 | 34 |
| 77 | AHYFNYGVANR | y8 | 2 | 15.5 | 656.32 | 940.46 | 34 |
| 78 | AHYFNYGVANR | y9 | 2 | 15.5 | 656.32 | 1103.53 | 34 |
| 79 | ANIGGVDDK | y5 | 2 | 9.6 | 444.72 | 533.26 | 25 |
| 80 | ANIGGVDDK | y6 | 2 | 9.6 | 444.72 | 590.28 | 25 |
| 81 | ANIGGVDDK | y7 | 2 | 9.6 | 444.72 | 703.36 | 25 |
| 82 | ESGSQVLFNK | y6 | 2 | 15.1 | 554.79 | 748.44 | 29 |
| 83 | ESGSQVLFNK | y7 | 2 | 15.1 | 554.79 | 835.47 | 29 |

TABLE 6-continued

| Transition number | Peptide | Fragment ion | Charge state of the precursor | Retention time | (m/z) filtered in Q1 | (m/z) filtered in Q3 | Collision energy |
|---|---|---|---|---|---|---|---|
| 84 | ESGSQVLFNK | y8 | 2 | 15.1 | 554.79 | 892.49 | 29 |
| 85 | GAMQLDDK | y5 | 2 | 11.5 | 439.21 | 618.31 | 24 |
| 86 | GAMQLDDK | y6 | 2 | 11.5 | 439.21 | 749.35 | 24 |
| 87 | GAMQLDDK | y7 | 2 | 11.5 | 439.21 | 820.39 | 24 |
| 88 | GIGIVMLANR | y6 | 2 | 18.7 | 522.31 | 703.39 | 28 |
| 89 | GIGIVMLANR | y7 | 2 | 18.7 | 522.31 | 816.48 | 28 |
| 90 | GIGIVMLANR | y8 | 2 | 18.7 | 522.31 | 873.5 | 28 |
| 91 | HAPWLK | y4 | 2 | 15 | 376.22 | 543.33 | 22 |
| 92 | HAPWLK | y5 | 2 | 15 | 376.22 | 614.37 | 22 |
| 93 | HAPWLK | b5 | 2 | 15 | 376.22 | 605.32 | 22 |
| 94 | IPGMAVAVLK | y6 | 2 | 18.1 | 499.81 | 600.41 | 27 |
| 95 | IPGMAVAVLK | y7 | 2 | 18.1 | 499.81 | 731.45 | 27 |
| 96 | IPGMAVAVLK | y8 | 2 | 18.1 | 499.81 | 788.47 | 27 |
| 97 | PVVDASIQPLLK | y7 | 2 | 19.3 | 640.38 | 798.51 | 33 |
| 98 | PVVDASIQPLLK | y8 | 2 | 19.3 | 640.38 | 869.55 | 33 |
| 99 | PVVDASIQPLLK | y9 | 2 | 19.3 | 640.38 | 984.57 | 33 |
| 100 | QAMASYAYGYSK | y7 | 2 | 15.5 | 670.3 | 851.39 | 34 |
| 101 | QAMASYAYGYSK | y8 | 2 | 15.5 | 670.3 | 938.43 | 34 |
| 102 | QAMASYAYGYSK | y9 | 2 | 15.5 | 670.3 | 1009.46 | 34 |
| 103 | QWAPVYSPGSHR | y8 | 2 | 14.8 | 692.84 | 902.45 | 35 |
| 104 | QWAPVYSPGSHR | y9 | 2 | 14.8 | 692.84 | 999.5 | 35 |
| 105 | QWAPVYSPGSHR | y10 | 2 | 14.8 | 692.84 | 1070.54 | 35 |
| 106 | QYSNPSIGLFGHLAASSLK | y11 | 2 | 22 | 995.52 | 1143.65 | 49 |
| 107 | QYSNPSIGLFGHLAASSLK | y12 | 2 | 22 | 995.52 | 1200.67 | 49 |
| 108 | QYSNPSIGLFGHLAASSLK | y11 | 2 | 22 | 664.02 | 1143.65 | 37 |
| 109 | TGSTNGFGAYVAFVPAR | y9 | 2 | 19.4 | 857.93 | 993.55 | 43 |
| 110 | TGSTNGFGAYVAFVPAR | y10 | 2 | 19.4 | 857.93 | 1050.57 | 43 |
| 111 | TGSTNGFGAYVAFVPAR | y11 | 2 | 19.4 | 857.93 | 1197.64 | 43 |
| 112 | TLTATLGAYAVVK | y8 | 2 | 18.3 | 654.38 | 820.49 | 34 |
| 113 | TLTATLGAYAVVK | y9 | 2 | 18.3 | 654.38 | 921.54 | 34 |
| 114 | TLTATLGAYAVVK | y10 | 2 | 18.3 | 654.38 | 992.58 | 34 |
| 115 | VNPGMLADEAYGIK | y8 | 2 | 18.8 | 739.37 | 866.43 | 38 |
| 116 | VNPGMLADEAYGIK | y9 | 2 | 18.8 | 739.37 | 979.51 | 38 |
| 117 | VNPGMLADEAYGIK | y10 | 2 | 18.8 | 739.37 | 1110.55 | 38 |
| 118 | PSGMSYEEAMTR | y10 | 2 | 15.5 | 679.79 | 1174.49 | 35 |
| 119 | PSGMSYEEAMTR | y9 | 2 | 15.5 | 679.79 | 1117.47 | 35 |
| 120 | PSGMSYEEAMTR | y8 | 2 | 15.5 | 679.79 | 986.42 | 35 |
| 121 | PYYFTWGK | y7 | 2 | 20.3 | 531.26 | 964.46 | 29 |

TABLE 6-continued

| Transition number | Peptide | Fragment ion | Charge state of the precursor | Retention time | (m/z) filtered in Q1 | (m/z) filtered in Q3 | Collision energy |
|---|---|---|---|---|---|---|---|
| 122 | PYYFTWGK | y6 | 2 | 20.3 | 531.26 | 801.39 | 29 |
| 123 | PYYFTWGK | y5 | 2 | 20.3 | 531.26 | 638.33 | 29 |

The areas obtained for each of the transitions and for each of the microorganisms studied were measured. When the areas of the 3 transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 8

Identification of a Resistance to CTX-M Beta-Lactams

The samples corresponding to a species able to comprise a CTX-M resistance mechanism can be detected by employing the following method.

Each sample is treated according to example 5, then analysed according to example 6 by detecting the peptides from TABLE 7 instead of the peptides from TABLE 3.

TABLE 7

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 1 | AGLPK | 2 | y4 | 9.5 | 243.16 | 414.27 | 16 |
| 2 | AGLPK | 2 | y3 | 9.5 | 243.16 | 357.25 | 16 |
| 3 | AGLPK | 2 | y2 | 9.5 | 243.16 | 244.17 | 16 |
| 4 | AGLPTSWTVGDK | 2 | y9 | 16.6 | 616.32 | 990.49 | 32 |
| 5 | AGLPTSWTVGDK | 2 | y8 | 16.6 | 616.32 | 893.44 | 32 |
| 6 | AGLPTSWTVGDK | 2 | y7 | 16.6 | 616.32 | 792.39 | 32 |
| 7 | AIGDETFR | 2 | y7 | 14 | 454.73 | 837.41 | 25 |
| 8 | AIGDETFR | 2 | y6 | 14 | 454.73 | 724.33 | 25 |
| 9 | AIGDETFR | 2 | y5 | 14 | 454.73 | 667.3 | 25 |
| 10 | ALAETQR | 2 | y6 | 7.4 | 394.72 | 717.39 | 22 |
| 11 | ALAETQR | 2 | y5 | 7.4 | 394.72 | 604.3 | 22 |
| 12 | ALAETQR | 2 | y4 | 7.4 | 394.72 | 533.27 | 22 |
| 13 | ALGDSQR | 2 | y6 | 7 | 373.69 | 675.34 | 21 |
| 14 | ALGDSQR | 2 | y5 | 7 | 373.69 | 562.26 | 21 |
| 15 | ALGDSQR | 2 | y4 | 7 | 373.69 | 505.24 | 21 |
| 16 | AMAQTLR | 2 | y6 | 12.1 | 395.72 | 719.39 | 22 |
| 17 | AMAQTLR | 2 | y5 | 12.1 | 395.72 | 588.35 | 22 |
| 18 | AMAQTLR | 2 | y4 | 12.1 | 395.72 | 517.31 | 22 |
| 19 | APLILVTYFTQPQPK | 2 | y9 | 22.4 | 858.49 | 1109.6 | 43 |
| 20 | APLILVTYFTQPQPK | 2 | y8 | 22.4 | 858.49 | 1008.5 | 43 |
| 21 | APLILVTYFTQPQPK | 2 | y7 | 22.4 | 858.49 | 845.45 | 43 |
| 22 | APLVLVTYFTQPQQNAESR | 3 | y9 | 21.4 | 721.38 | 1057.5 | 40 |
| 23 | APLVLVTYFTQPQQNAESR | 3 | y8 | 21.4 | 721.38 | 929.44 | 40 |
| 24 | APLVLVTYFTQPQQNAESR | 3 | y7 | 21.4 | 721.38 | 832.39 | 40 |
| 25 | AQLVTWLK | 2 | y7 | 21 | 479.79 | 887.53 | 26 |

TABLE 7-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 26 | AQLVTWLK | 2 | y6 | 21 | 479.79 | 759.48 | 26 |
| 27 | AQLVTWLK | 2 | y5 | 21 | 479.79 | 646.39 | 26 |
| 28 | AQLVTWMK | 2 | y7 | 19 | 488.77 | 905.49 | 27 |
| 29 | AQLVTWMK | 2 | y6 | 19 | 488.77 | 777.43 | 27 |
| 30 | AQLVTWMK | 2 | y5 | 19 | 488.77 | 664.35 | 27 |
| 31 | DILAAAAK | 2 | y7 | 12.1 | 386.73 | 657.43 | 22 |
| 32 | DILAAAAK | 2 | y6 | 12.1 | 386.73 | 544.35 | 22 |
| 33 | DILAAAAK | 2 | y5 | 12.1 | 386.73 | 431.26 | 22 |
| 34 | DTTSPR | 2 | y5 | 4.6 | 338.67 | 561.3 | 20 |
| 35 | DTTSPR | 2 | y4 | 4.6 | 338.67 | 460.25 | 20 |
| 36 | DTTSPR | 2 | y3 | 4.6 | 338.67 | 359.2 | 20 |
| 37 | DTTTPLAMAQTLK | 2 | y9 | 17 | 695.87 | 972.55 | 36 |
| 38 | DTTTPLAMAQTLK | 2 | y8 | 17 | 695.87 | 875.5 | 36 |
| 39 | DTTTPLAMAQTLK | 2 | y7 | 17 | 695.87 | 762.42 | 36 |
| 40 | DTTTPR | 2 | y5 | 4.8 | 345.67 | 575.31 | 20 |
| 41 | DTTTPR | 2 | y4 | 4.8 | 345.67 | 474.27 | 20 |
| 42 | DTTTPR | 2 | y3 | 4.8 | 345.67 | 373.22 | 20 |
| 43 | DVLAAAAK | 2 | y7 | 10.5 | 379.72 | 643.41 | 22 |
| 44 | DVLAAAAK | 2 | y6 | 10.5 | 379.72 | 544.35 | 22 |
| 45 | DVLAAAAK | 2 | y5 | 10.5 | 379.72 | 431.26 | 22 |
| 46 | DVLASAAK | 2 | y7 | 10.8 | 387.72 | 659.41 | 22 |
| 47 | DVLASAAK | 2 | y6 | 10.8 | 387.72 | 560.34 | 22 |
| 48 | DVLASAAK | 2 | y5 | 10.8 | 387.72 | 447.26 | 22 |
| 49 | DVLASAAR | 2 | y7 | 11.4 | 401.72 | 687.41 | 23 |
| 50 | DVLASAAR | 2 | y6 | 11.4 | 401.72 | 588.35 | 23 |
| 51 | DVLASAAR | 2 | y5 | 11.4 | 401.72 | 475.26 | 23 |
| 52 | FAMCSTSK | 2 | y7 | 11.1 | 466.2 | 784.33 | 26 |
| 53 | FAMCSTSK | 2 | y6 | 11.1 | 466.2 | 713.3 | 26 |
| 54 | FAMCSTSK | 2 | y5 | 11.1 | 466.2 | 582.26 | 26 |
| 55 | FPMCSTSK | 2 | y7 | 12.1 | 479.21 | 810.35 | 26 |
| 56 | FPMCSTSK | 2 | y6 | 12.1 | 479.21 | 713.3 | 26 |
| 57 | FPMCSTSK | 2 | y5 | 12.1 | 479.21 | 582.26 | 26 |
| 58 | GNTTGAASIQAGLPASWVVGDK | 3 | y9 | 19.5 | 700.7 | 958.5 | 39 |
| 59 | GNTTGAASIQAGLPASWVVGDK | 3 | y8 | 19.5 | 700.7 | 861.45 | 39 |
| 60 | GNTTGAASIQAGLPASWVVGDK | 3 | y7 | 19.5 | 700.7 | 790.41 | 39 |
| 61 | GNTTGAASIQAGLPTSWVVGDK | 3 | y9 | 19.3 | 710.7 | 988.51 | 40 |
| 62 | GNTTGAASIQAGLPTSWVVGDK | 3 | y8 | 19.3 | 710.7 | 891.46 | 40 |
| 63 | GNTTGAASIQAGLPTSWVVGDK | 3 | y7 | 19.3 | 710.7 | 790.41 | 40 |

TABLE 7-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 64 | GNTTGAASIR | 2 | y9 | 9 | 474.25 | 890.47 | 26 |
| 65 | GNTTGAASIR | 2 | y8 | 9 | 474.25 | 776.43 | 26 |
| 66 | GNTTGAASIR | 2 | y7 | 9 | 474.25 | 675.38 | 26 |
| 67 | GNTTGSASIR | 2 | y9 | 8.5 | 482.25 | 906.46 | 26 |
| 68 | GNTTGSASIR | 2 | y8 | 8.5 | 482.25 | 792.42 | 26 |
| 69 | GNTTGSASIR | 2 | y7 | 8.5 | 482.25 | 691.37 | 26 |
| 70 | HLLNQR | 2 | y5 | 10.2 | 390.73 | 643.39 | 22 |
| 71 | HLLNQR | 2 | y4 | 10.2 | 390.73 | 530.3 | 22 |
| 72 | HLLNQR | 2 | y3 | 10.2 | 390.73 | 417.22 | 22 |
| 73 | LAALEK | 2 | y5 | 11 | 322.7 | 531.31 | 19 |
| 74 | LAALEK | 2 | y4 | 11 | 322.7 | 460.28 | 19 |
| 75 | LAALEK | 2 | y3 | 11 | 322.7 | 389.24 | 19 |
| 76 | LAELER | 2 | y5 | 12.1 | 365.71 | 617.33 | 21 |
| 77 | LAELER | 2 | y4 | 12.1 | 365.71 | 546.29 | 21 |
| 78 | LAELER | 2 | y3 | 12.1 | 365.71 | 417.25 | 21 |
| 79 | LGVALIDTADNTQVLYR | 2 | y9 | 21.4 | 931.5 | 1079.6 | 46 |
| 80 | LGVALIDTADNTQVLYR | 2 | y8 | 21.4 | 931.5 | 1008.5 | 46 |
| 81 | LGVALIDTADNTQVLYR | 2 | y7 | 21.4 | 931.5 | 893.48 | 46 |
| 82 | LGVALINTADNSQILYR | 2 | y9 | 21.1 | 931.01 | 1079.6 | 46 |
| 83 | LGVALINTADNSQILYR | 2 | y8 | 21.1 | 931.01 | 1008.5 | 46 |
| 84 | LGVALINTADNSQILYR | 2 | y7 | 21.1 | 931.01 | 893.48 | 46 |
| 85 | LIAHLGGPDK | 2 | y9 | 12.7 | 510.8 | 907.5 | 27 |
| 86 | LIAHLGGPDK | 2 | y8 | 12.7 | 510.8 | 794.42 | 27 |
| 87 | LIAHLGGPDK | 2 | y7 | 12.7 | 510.8 | 723.38 | 27 |
| 88 | LIAHVGGPASVTAFAR | 2 | y9 | 17.5 | 783.94 | 919.5 | 39 |
| 89 | LIAHVGGPASVTAFAR | 2 | y8 | 17.5 | 783.94 | 822.45 | 39 |
| 90 | LIAHVGGPASVTAFAR | 2 | y7 | 17.5 | 783.94 | 751.41 | 39 |
| 91 | LIAQLGGPGGVTAFAR | 2 | y9 | 19.3 | 764.44 | 875.47 | 39 |
| 92 | LIAQLGGPGGVTAFAR | 2 | y8 | 19.3 | 764.44 | 778.42 | 39 |
| 93 | LIAQLGGPGGVTAFAR | 2 | y7 | 19.3 | 764.44 | 721.4 | 39 |
| 94 | NLTLGK | 2 | y5 | 12.2 | 323.2 | 531.35 | 19 |
| 95 | NLTLGK | 2 | y4 | 12.2 | 323.2 | 418.27 | 19 |
| 96 | NLTLGK | 2 | y3 | 12.2 | 323.2 | 317.22 | 19 |
| 97 | QLGDETFR | 2 | y7 | 14.4 | 483.24 | 837.41 | 26 |
| 98 | QLGDETFR | 2 | y6 | 14.4 | 483.24 | 724.33 | 26 |
| 99 | QLGDETFR | 2 | y5 | 14.4 | 483.24 | 667.3 | 26 |
| 100 | QLLNQPVEIK | 2 | y9 | 16.2 | 591.35 | 1053.6 | 31 |
| 101 | QLLNQPVEIK | 2 | y8 | 16.2 | 591.35 | 940.55 | 31 |

TABLE 7-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 102 | QLLNQPVEIK | 2 | y7 | 16.2 | 591.35 | 827.46 | 31 |
| 103 | QLTLGHALGETQR | 2 | y9 | 14.9 | 712.39 | 968.49 | 36 |
| 104 | QLTLGHALGETQR | 2 | y8 | 14.9 | 712.39 | 911.47 | 36 |
| 105 | QLTLGHALGETQR | 2 | y7 | 14.9 | 712.39 | 774.41 | 36 |
| 106 | QSESDK | 2 | y5 | 1.7 | 347.16 | 565.25 | 20 |
| 107 | QSESDK | 2 | y4 | 1.7 | 347.16 | 478.21 | 20 |
| 108 | QSESDK | 2 | y3 | 1.7 | 347.16 | 349.17 | 20 |
| 109 | QSETQK | 2 | y5 | 3.7 | 360.68 | 592.29 | 21 |
| 110 | QSETQK | 2 | y4 | 3.7 | 360.68 | 505.26 | 21 |
| 111 | QSETQK | 2 | y3 | 3.7 | 360.68 | 376.22 | 21 |
| 112 | QSGGR | 2 | y4 | 5.5 | 252.63 | 376.19 | 16 |
| 113 | QSGGR | 2 | y3 | 5.5 | 252.63 | 289.16 | 16 |
| 114 | QSGGR | 2 | b4 | 5.5 | 252.63 | 330.14 | 16 |
| 115 | SDLVNYNPIAEK | 2 | y9 | 17.1 | 681.85 | 1047.6 | 35 |
| 116 | SDLVNYNPIAEK | 2 | y8 | 17.1 | 681.85 | 948.48 | 35 |
| 117 | SDLVNYNPIAEK | 2 | y7 | 17.1 | 681.85 | 834.44 | 35 |
| 118 | SESEPNLLNQR | 2 | y9 | 13.3 | 643.82 | 1070.6 | 33 |
| 119 | SESEPNLLNQR | 2 | y8 | 13.3 | 643.82 | 983.53 | 33 |
| 120 | SESEPNLLNQR | 2 | y7 | 13.3 | 643.82 | 854.48 | 33 |
| 121 | SLGDETFR | 2 | y7 | 14.6 | 462.72 | 837.41 | 25 |
| 122 | SLGDETFR | 2 | y6 | 14.6 | 462.72 | 724.33 | 25 |
| 123 | SLGDETFR | 2 | y5 | 14.6 | 462.72 | 667.3 | 25 |
| 124 | SSGGR | 2 | y4 | 5.9 | 232.12 | 376.19 | 15 |
| 125 | SSGGR | 2 | y3 | 5.9 | 232.12 | 289.16 | 15 |
| 126 | SWVVGDK | 2 | y6 | 14.2 | 395.71 | 703.38 | 22 |
| 127 | SWVVGDK | 2 | y5 | 14.2 | 395.71 | 517.3 | 22 |
| 128 | SWVVGDK | 2 | y4 | 14.2 | 395.71 | 418.23 | 22 |
| 129 | TEPTLNTAIPGDPR | 2 | y9 | 15.6 | 741.38 | 940.48 | 38 |
| 130 | TEPTLNTAIPGDPR | 2 | y8 | 15.6 | 741.38 | 826.44 | 38 |
| 131 | TEPTLNTAIPGDPR | 2 | y7 | 15.6 | 741.38 | 725.39 | 38 |
| 132 | TGSGDYGTTNDIAVIWPK | 2 | y8 | 19.9 | 947.96 | 941.55 | 47 |
| 133 | TGSGDYGTTNDIAVIWPK | 2 | y7 | 19.9 | 947.96 | 826.52 | 47 |
| 134 | TGSGDYGTTNDIAVIWPK | 2 | y6 | 19.9 | 947.96 | 713.43 | 47 |
| 135 | TGSGDYGTTNDIAVIWPQGR | 3 | y9 | 19.7 | 703.34 | 1039.6 | 39 |
| 136 | TGSGDYGTTNDIAVIWPQGR | 3 | y8 | 19.7 | 703.34 | 926.52 | 39 |
| 137 | TGSGDYGTTNDIAVIWPQGR | 3 | y7 | 19.7 | 703.34 | 855.48 | 39 |
| 138 | TGSGGYGTTNDIAVIWPK | 2 | y9 | 19.5 | 918.96 | 1055.6 | 45 |
| 139 | TGSGGYGTTNDIAVIWPK | 2 | y8 | 19.5 | 918.96 | 941.55 | 45 |

TABLE 7-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 140 | TGSGGYGTTNDIAVIWPK | 2 | y7 | 19.5 | 918.96 | 826.52 | 45 |
| 141 | VMAAAAVLK | 2 | y8 | 15.3 | 437.26 | 774.45 | 24 |
| 142 | VMAAAAVLK | 2 | y7 | 15.3 | 437.26 | 643.41 | 24 |
| 143 | VMAAAAVLK | 2 | y6 | 15.3 | 437.26 | 572.38 | 24 |
| 144 | VMAVAAVLK | 2 | y8 | 16.3 | 451.28 | 802.49 | 25 |
| 145 | VMAVAAVLK | 2 | y7 | 16.3 | 451.28 | 671.45 | 25 |
| 146 | VMAVAAVLK | 2 | y6 | 16.3 | 451.28 | 600.41 | 25 |
| 147 | VTAFAR | 2 | y5 | 11.6 | 332.69 | 565.31 | 20 |
| 148 | VTAFAR | 2 | y4 | 11.6 | 332.69 | 464.26 | 20 |
| 149 | VTAFAR | 2 | y3 | 11.6 | 332.69 | 393.22 | 20 |

The areas obtained for each of the transitions and for each of the microorganisms studied were measured. When the areas of the 3 transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 9

Identification of a Resistance to SHV Beta-Lactams

The samples corresponding to a species able to comprise an SHV resistance mechanism can be detected by employing the following method.

Each sample is treated according to example 5, then analysed according to example 6 by detecting the peptides from TABLE 8 instead of the peptides from TABLE 3.

TABLE 8

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 1 | AGAGER | 2 | y5 | 5 | 280.64 | 489.24 | 17 |
| 2 | AGAGER | 2 | y4 | 5 | 280.64 | 432.22 | 17 |
| 3 | AGAGER | 2 | y3 | 5 | 280.64 | 361.18 | 17 |
| 4 | ATTTPASMAATLR | 2 | y9 | 15.1 | 646.34 | 917.49 | 33 |
| 5 | ATTTPASMAATLR | 2 | y8 | 15.1 | 646.34 | 820.43 | 33 |
| 6 | ATTTPASMAATLR | 2 | y7 | 15.1 | 646.34 | 749.4 | 33 |
| 7 | CIISLLATLPLAVHASPQPLEQIK | 3 | y9 | 27.3 | 871.5 | 1039.6 | 48 |
| 8 | CIISLLATLPLAVHASPQPLEQIK | 3 | y8 | 27.3 | 871.5 | 952.55 | 48 |
| 9 | CIISLLATLPLAVHASPQPLEQIK | 3 | y7 | 27.3 | 871.5 | 855.49 | 48 |
| 10 | DMPASMAER | 2 | y8 | 12 | 504.22 | 892.4 | 27 |
| 11 | DMPASMAER | 2 | y7 | 12 | 504.22 | 761.36 | 27 |
| 12 | DMPASMAER | 2 | y6 | 12 | 504.22 | 664.31 | 27 |
| 13 | DSPASMAER | 2 | y8 | 8.8 | 482.21 | 848.39 | 26 |
| 14 | DSPASMAER | 2 | y7 | 8.8 | 482.21 | 761.36 | 26 |
| 15 | DSPASMAER | 2 | y6 | 8.8 | 482.21 | 664.31 | 26 |
| 16 | DTLASMAER | 2 | y8 | 13.3 | 497.24 | 878.44 | 27 |
| 17 | DTLASMAER | 2 | y7 | 13.3 | 497.24 | 777.39 | 27 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 18 | DTLASMAER | 2 | y6 | 13.3 | 497.24 | 664.31 | 27 |
| 19 | DTPASMAER | 2 | y8 | 9.2 | 489.22 | 862.41 | 27 |
| 20 | DTPASMAER | 2 | y7 | 9.2 | 489.22 | 761.36 | 27 |
| 21 | DTPASMAER | 2 | y6 | 9.2 | 489.22 | 664.31 | 27 |
| 22 | DTPASMAK | 2 | y7 | 8.5 | 410.7 | 705.36 | 23 |
| 23 | DTPASMAK | 2 | y6 | 8.5 | 410.7 | 604.31 | 23 |
| 24 | DTPASMAK | 2 | y5 | 8.5 | 410.7 | 507.26 | 23 |
| 25 | DTTTPASMAATLR | 2 | y9 | 15.2 | 668.33 | 917.49 | 34 |
| 26 | DTTTPASMAATLR | 2 | y8 | 15.2 | 668.33 | 820.43 | 34 |
| 27 | DTTTPASMAATLR | 2 | y7 | 15.2 | 668.33 | 749.4 | 34 |
| 28 | DTTTPASMAGTLR | 2 | y9 | 15.1 | 661.32 | 903.47 | 34 |
| 29 | DTTTPASMAGTLR | 2 | y8 | 15.1 | 661.32 | 806.42 | 34 |
| 30 | DTTTPASMAGTLR | 2 | y7 | 15.1 | 661.32 | 735.38 | 34 |
| 31 | DTTTPASMTATLR | 2 | y9 | 14.9 | 683.34 | 947.5 | 35 |
| 32 | DTTTPASMTATLR | 2 | y8 | 14.9 | 683.34 | 850.45 | 35 |
| 33 | DTTTPASMTATLR | 2 | y7 | 14.9 | 683.34 | 779.41 | 35 |
| 34 | FPMISTFK | 2 | y7 | 19.7 | 485.76 | 823.44 | 26 |
| 35 | FPMISTFK | 2 | y6 | 19.7 | 485.76 | 726.39 | 26 |
| 36 | FPMISTFK | 2 | y5 | 19.7 | 485.76 | 595.34 | 26 |
| 37 | FPMMSTFK | 2 | y7 | 19.3 | 494.74 | 841.39 | 27 |
| 38 | FPMMSTFK | 2 | y6 | 19.3 | 494.74 | 744.34 | 27 |
| 39 | FPMMSTFK | 2 | y5 | 19.3 | 494.74 | 613.3 | 27 |
| 40 | GIVALLGGNIK | 2 | y9 | 18.4 | 527.83 | 884.56 | 28 |
| 41 | GIVALLGGNIK | 2 | y8 | 18.4 | 527.83 | 785.49 | 28 |
| 42 | GIVALLGGNIK | 2 | y7 | 18.4 | 527.83 | 714.45 | 28 |
| 43 | GIVALLGPDNK | 2 | y8 | 16.9 | 548.82 | 827.46 | 29 |
| 44 | GIVALLGPDNK | 2 | y7 | 16.9 | 548.82 | 756.43 | 29 |
| 45 | GIVALLGPDNK | 2 | y6 | 16.9 | 548.82 | 643.34 | 29 |
| 46 | GIVALLGPNHK | 2 | y9 | 16.3 | 559.84 | 948.56 | 30 |
| 47 | GIVALLGPNHK | 2 | y8 | 16.3 | 559.84 | 849.49 | 30 |
| 48 | GIVALLGPNHK | 2 | y7 | 16.3 | 559.84 | 778.46 | 30 |
| 49 | GIVALLGPNNK | 2 | y9 | 16.5 | 548.33 | 925.55 | 29 |
| 50 | GIVALLGPNNK | 2 | y8 | 16.5 | 548.33 | 826.48 | 29 |
| 51 | GIVALLGPNNK | 2 | y7 | 16.5 | 548.33 | 755.44 | 29 |
| 52 | GIVALLGPNNNAER | 2 | y9 | 16.4 | 719.39 | 984.49 | 37 |
| 53 | GIVALLGPNNNAER | 2 | y8 | 16.4 | 719.39 | 871.4 | 37 |
| 54 | GIVALLGPNNNAER | 2 | y7 | 16.4 | 719.39 | 814.38 | 37 |
| 55 | GIVALR | 2 | y5 | 14.2 | 314.71 | 571.39 | 19 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 56 | GIVALR | 2 | y4 | 14.2 | 314.71 | 458.31 | 19 |
| 57 | GIVALR | 2 | y3 | 14.2 | 314.71 | 359.24 | 19 |
| 58 | GPNNK | 2 | y4 | 5.3 | 265.14 | 472.25 | 17 |
| 59 | GPNNK | 2 | y3 | 5.3 | 265.14 | 375.2 | 17 |
| 60 | GPNNK | 2 | b4 | 5.3 | 265.14 | 383.17 | 17 |
| 61 | GTTTPASMAATLR | 2 | y9 | 15.3 | 639.33 | 917.49 | 33 |
| 62 | GTTTPASMAATLR | 2 | y8 | 15.3 | 639.33 | 820.43 | 33 |
| 63 | GTTTPASMAATLR | 2 | y7 | 15.3 | 639.33 | 749.4 | 33 |
| 64 | HLADGMTVGELCAAAITMSDNSAAK | 3 | y9 | 20 | 845.39 | 924.41 | 46 |
| 65 | HLADGMTVGELCAAAITMSDNSAAK | 3 | y8 | 20 | 845.39 | 823.36 | 46 |
| 66 | HLADGMTVGELCAAAITMSDNSAAK | 3 | y7 | 20 | 845.39 | 692.32 | 46 |
| 67 | HLLQWMVDDR | 2 | y9 | 21.2 | 656.83 | 1175.6 | 34 |
| 68 | HLLQWMVDDR | 2 | y8 | 21.2 | 656.83 | 1062.5 | 34 |
| 69 | HLLQWMVDDR | 2 | y7 | 21.2 | 656.83 | 949.42 | 34 |
| 70 | IHYLQQDLVDYSPVSEK | 3 | y9 | 19.9 | 678.68 | 1023.5 | 38 |
| 71 | IHYLQQDLVDYSPVSEK | 3 | y8 | 19.9 | 678.68 | 924.43 | 38 |
| 72 | IHYLQQDLVDYSPVSEK | 3 | y7 | 19.9 | 678.68 | 809.4 | 38 |
| 73 | IVVIYLR | 2 | y6 | 19.1 | 438.29 | 762.49 | 24 |
| 74 | IVVIYLR | 2 | y5 | 19.1 | 438.29 | 663.42 | 24 |
| 75 | IVVIYLR | 2 | y4 | 19.1 | 438.29 | 564.35 | 24 |
| 76 | LCIISLLAALPLAVHASPQPLEQIK | 3 | y9 | 29.8 | 899.19 | 1039.6 | 49 |
| 77 | LCIISLLAALPLAVHASPQPLEQIK | 3 | y8 | 29.8 | 899.19 | 952.55 | 49 |
| 78 | LCIISLLAALPLAVHASPQPLEQIK | 3 | y7 | 29.8 | 899.19 | 855.49 | 49 |
| 79 | LCIISLLATLPLAVHASPQPLDQIK | 3 | y9 | 29.5 | 904.52 | 1025.6 | 49 |
| 80 | LCIISLLATLPLAVHASPQPLDQIK | 3 | y8 | 29.5 | 904.52 | 938.53 | 49 |
| 81 | LCIISLLATLPLAVHASPQPLDQIK | 3 | y7 | 29.5 | 904.52 | 841.48 | 49 |
| 82 | LCIISLLATLPLAVHASPQPLEQIK | 3 | y9 | 29.6 | 909.19 | 1039.6 | 49 |
| 83 | LCIISLLATLPLAVHASPQPLEQIK | 3 | y8 | 29.6 | 909.19 | 952.55 | 49 |
| 84 | LCIISLLATLPLAVHASPQPLEQIK | 3 | y7 | 29.6 | 909.19 | 855.49 | 49 |
| 85 | LCIISLLATLPLAVHSSPQPLEQIK | 3 | y9 | 29.3 | 914.53 | 1039.6 | 50 |
| 86 | LCIISLLATLPLAVHSSPQPLEQIK | 3 | y8 | 29.3 | 914.53 | 952.55 | 50 |
| 87 | LCIISLLATLPLAVHSSPQPLEQIK | 3 | y7 | 29.3 | 914.53 | 855.49 | 50 |
| 88 | LCIISLLATLPLAVHTSPQPLEQIK | 3 | y9 | 29.5 | 919.2 | 1039.6 | 50 |
| 89 | LCIISLLATLPLAVHTSPQPLEQIK | 3 | y8 | 29.5 | 919.2 | 952.55 | 50 |
| 90 | LCIISLLATLPLAVHTSPQPLEQIK | 3 | y7 | 29.5 | 919.2 | 855.49 | 50 |
| 91 | LCIISLLATLPLTVHASPQPLEQIK | 3 | y9 | 29.3 | 919.2 | 1039.6 | 50 |
| 92 | LCIISLLATLPLTVHASPQPLEQIK | 3 | y8 | 29.3 | 919.2 | 952.55 | 50 |
| 93 | LCIISLLATLPLTVHASPQPLEQIK | 3 | y7 | 29.3 | 919.2 | 855.49 | 50 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 94 | LCIISLLATLPLVVHASPQPLEQIK | 3 | y9 | 30.3 | 918.54 | 1039.6 | 50 |
| 95 | LCIISLLATLPLVVHASPQPLEQIK | 3 | y8 | 30.3 | 918.54 | 952.55 | 50 |
| 96 | LCIISLLATLPLVVHASPQPLEQIK | 3 | y7 | 30.3 | 918.54 | 855.49 | 50 |
| 97 | LCIISLLATLSLAVHASPQPLEQIK | 3 | y9 | 29.5 | 905.85 | 1039.6 | 49 |
| 98 | LCIISLLATLSLAVHASPQPLEQIK | 3 | y8 | 29.5 | 905.85 | 952.55 | 49 |
| 99 | LCIISLLATLSLAVHASPQPLEQIK | 3 | y7 | 29.5 | 905.85 | 855.49 | 49 |
| 100 | LCIISLLATMPLAVHASPQPLEQIK | 3 | y9 | 27.4 | 915.18 | 1039.6 | 50 |
| 101 | LCIISLLATMPLAVHASPQPLEQIK | 3 | y8 | 27.4 | 915.18 | 952.55 | 50 |
| 102 | LCIISLLATMPLAVHASPQPLEQIK | 3 | y7 | 27.4 | 915.18 | 855.49 | 50 |
| 103 | LCIISLLAVLPLAVHASPQPLEQIK | 3 | y9 | 30.5 | 908.53 | 1039.6 | 49 |
| 104 | LCIISLLAVLPLAVHASPQPLEQIK | 3 | y8 | 30.5 | 908.53 | 952.55 | 49 |
| 105 | LCIISLLAVLPLAVHASPQPLEQIK | 3 | y7 | 30.5 | 908.53 | 855.49 | 49 |
| 106 | LLISQR | 2 | y5 | 12.9 | 365.23 | 616.38 | 21 |
| 107 | LLISQR | 2 | y4 | 12.9 | 365.23 | 503.29 | 21 |
| 108 | LLISQR | 2 | y3 | 12.9 | 365.23 | 390.21 | 21 |
| 109 | LLLATVGGPAGLTAFLR | 2 | y9 | 24 | 835.5 | 945.55 | 42 |
| 110 | LLLATVGGPAGLTAFLR | 2 | y8 | 24 | 835.5 | 848.5 | 42 |
| 111 | LLLATVGGPAGLTAFLR | 2 | y7 | 24 | 835.5 | 777.46 | 42 |
| 112 | LLNSQR | 2 | y5 | 9.4 | 365.71 | 617.34 | 21 |
| 113 | LLNSQR | 2 | y4 | 9.4 | 365.71 | 504.25 | 21 |
| 114 | LLNSQR | 2 | y3 | 9.4 | 365.71 | 390.21 | 21 |
| 115 | LLTNQR | 2 | y5 | 9.8 | 372.72 | 631.35 | 21 |
| 116 | LLTNQR | 2 | y4 | 9.8 | 372.72 | 518.27 | 21 |
| 117 | LLTNQR | 2 | y3 | 9.8 | 372.72 | 417.22 | 21 |
| 118 | LLTSQR | 2 | y5 | 9.8 | 359.22 | 604.34 | 21 |
| 119 | LLTSQR | 2 | y4 | 9.8 | 359.22 | 491.26 | 21 |
| 120 | LLTSQR | 2 | y3 | 9.8 | 359.22 | 390.21 | 21 |
| 121 | LNIISLLATLPLAVHASPQPLEQIK | 3 | y9 | 29.6 | 893.87 | 1039.6 | 49 |
| 122 | LNIISLLATLPLAVHASPQPLEQIK | 3 | y8 | 29.6 | 893.87 | 952.55 | 49 |
| 123 | LNIISLLATLPLAVHASPQPLEQIK | 3 | y7 | 29.6 | 893.87 | 855.49 | 49 |
| 124 | LSASSQR | 2 | y6 | 6.2 | 374.7 | 635.31 | 21 |
| 125 | LSASSQR | 2 | y5 | 6.2 | 374.7 | 548.28 | 21 |
| 126 | LSASSQR | 2 | y4 | 6.2 | 374.7 | 477.24 | 21 |
| 127 | LSESQLSGR | 2 | y8 | 10.5 | 488.76 | 863.42 | 27 |
| 128 | LSESQLSGR | 2 | y7 | 10.5 | 488.76 | 776.39 | 27 |
| 129 | LSESQLSGR | 2 | y6 | 10.5 | 488.76 | 647.35 | 27 |
| 130 | LSESQLSGSVGMIEMDLASGR | 3 | y9 | 21.1 | 723.02 | 991.49 | 40 |
| 131 | LSESQLSGSVGMIEMDLASGR | 3 | y8 | 21.1 | 723.02 | 878.4 | 40 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 132 | LSESQLSGSVGMIEMDLASGR | 3 | y7 | 21.1 | 723.02 | 749.36 | 40 |
| 133 | MVVIYLR | 2 | y6 | 18.9 | 447.27 | 762.49 | 25 |
| 134 | MVVIYLR | 2 | y5 | 18.9 | 447.27 | 663.42 | 25 |
| 135 | MVVIYLR | 2 | y4 | 18.9 | 447.27 | 564.35 | 25 |
| 136 | NEALPGDAR | 2 | y8 | 10.6 | 471.74 | 828.42 | 26 |
| 137 | NEALPGDAR | 2 | y7 | 10.6 | 471.74 | 699.38 | 26 |
| 138 | NEALPGDAR | 2 | y6 | 10.6 | 471.74 | 628.34 | 26 |
| 139 | NQHIAGIGAALIEHWQR | 2 | y9 | 21.2 | 957.51 | 1123.6 | 47 |
| 140 | NQHIAGIGAALIEHWQR | 2 | y8 | 21.2 | 957.51 | 1052.6 | 47 |
| 141 | NQHIAGIGAALIEHWQR | 2 | y7 | 21.2 | 957.51 | 981.53 | 47 |
| 142 | NQQIAGIGAALIEHWQR | 2 | y9 | 22.1 | 953.01 | 1123.6 | 47 |
| 143 | NQQIAGIGAALIEHWQR | 2 | y8 | 22.1 | 953.01 | 1052.6 | 47 |
| 144 | NQQIAGIGAALIEHWQR | 2 | y7 | 22.1 | 953.01 | 981.53 | 47 |
| 145 | NQQIAGLGAALIEHWQR | 2 | y9 | 22.3 | 953.01 | 1123.6 | 47 |
| 146 | NQQIAGLGAALIEHWQR | 2 | y8 | 22.3 | 953.01 | 1052.6 | 47 |
| 147 | NQQIAGLGAALIEHWQR | 2 | y7 | 22.3 | 953.01 | 981.53 | 47 |
| 148 | NTTTPASMAATLR | 2 | y9 | 15.3 | 667.84 | 917.49 | 34 |
| 149 | NTTTPASMAATLR | 2 | y8 | 15.3 | 667.84 | 820.43 | 34 |
| 150 | NTTTPASMAATLR | 2 | y7 | 15.3 | 667.84 | 749.4 | 34 |
| 151 | NVLTSQR | 2 | y6 | 9.6 | 409.23 | 703.41 | 23 |
| 152 | NVLTSQR | 2 | y5 | 9.6 | 409.23 | 604.34 | 23 |
| 153 | NVLTSQR | 2 | y4 | 9.6 | 409.23 | 491.26 | 23 |
| 154 | QIDDNVTR | 2 | y7 | 9.4 | 480.74 | 832.42 | 26 |
| 155 | QIDDNVTR | 2 | y6 | 9.4 | 480.74 | 719.33 | 26 |
| 156 | QIDDNVTR | 2 | y5 | 9.4 | 480.74 | 604.3 | 26 |
| 157 | QIGDK | 2 | y4 | 5.8 | 280.66 | 432.25 | 17 |
| 158 | QIGDK | 2 | y3 | 5.8 | 280.66 | 319.16 | 17 |
| 159 | QIGDK | 2 | b4 | 5.8 | 280.66 | 414.2 | 17 |
| 160 | QIGDNVTR | 2 | y7 | 9.5 | 451.74 | 774.41 | 25 |
| 161 | QIGDNVTR | 2 | y6 | 9.5 | 451.74 | 661.33 | 25 |
| 162 | QIGDNVTR | 2 | y5 | 9.5 | 451.74 | 604.3 | 25 |
| 163 | QIGENVTR | 2 | y7 | 9.5 | 458.75 | 788.43 | 25 |
| 164 | QIGENVTR | 2 | y6 | 9.5 | 458.75 | 675.34 | 25 |
| 165 | QIGENVTR | 2 | y5 | 9.5 | 458.75 | 618.32 | 25 |
| 166 | QLLQWMVDAR | 2 | y9 | 21.5 | 630.33 | 1131.6 | 33 |
| 167 | QLLQWMVDAR | 2 | y8 | 21.5 | 630.33 | 1018.5 | 33 |
| 168 | QLLQWMVDAR | 2 | y7 | 21.5 | 630.33 | 905.43 | 33 |
| 169 | QLLQWMVDDGVAGPLIR | 2 | y9 | 25 | 956.01 | 897.52 | 47 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 170 | QLLQWMVDDGVAGPLIR | 2 | y8 | 25 | 956.01 | 782.49 | 47 |
| 171 | QLLQWMVDDGVAGPLIR | 2 | y7 | 25 | 956.01 | 725.47 | 47 |
| 172 | QLLQWMVDDR | 2 | y9 | 21.7 | 652.33 | 1175.6 | 34 |
| 173 | QLLQWMVDDR | 2 | y8 | 21.7 | 652.33 | 1062.5 | 34 |
| 174 | QLLQWMVDDR | 2 | y7 | 21.7 | 652.33 | 949.42 | 34 |
| 175 | QLLQWMVDGR | 2 | y8 | 21.3 | 623.32 | 1004.5 | 32 |
| 176 | QLLQWMVDGR | 2 | y7 | 21.3 | 623.32 | 891.41 | 32 |
| 177 | QLLQWMVDGR | 2 | y6 | 21.3 | 623.32 | 763.36 | 32 |
| 178 | QLLQWMVEDR | 2 | y9 | 21.9 | 659.33 | 1189.6 | 34 |
| 179 | QLLQWMVEDR | 2 | y8 | 21.9 | 659.33 | 1076.5 | 34 |
| 180 | QLLQWMVEDR | 2 | y7 | 21.9 | 659.33 | 963.44 | 34 |
| 181 | QQDLVDYSPVSEK | 2 | y9 | 15.6 | 754.37 | 1023.5 | 38 |
| 182 | QQDLVDYSPVSEK | 2 | y8 | 15.6 | 754.37 | 924.43 | 38 |
| 183 | QQDLVDYSPVSEK | 2 | y7 | 15.6 | 754.37 | 809.4 | 38 |
| 184 | QQHLVDYSPVSEK | 2 | y9 | 13.9 | 765.38 | 1023.5 | 39 |
| 185 | QQHLVDYSPVSEK | 2 | y8 | 13.9 | 765.38 | 924.43 | 39 |
| 186 | QQHLVDYSPVSEK | 2 | y7 | 13.9 | 765.38 | 809.4 | 39 |
| 187 | QSESQLSGR | 2 | y8 | 7.6 | 496.24 | 863.42 | 27 |
| 188 | QSESQLSGR | 2 | y7 | 7.6 | 496.24 | 776.39 | 27 |
| 189 | QSESQLSGR | 2 | y6 | 7.6 | 496.24 | 647.35 | 27 |
| 190 | QSESQLSGSVGMIEMDLASGR | 3 | y9 | 19.7 | 728.01 | 991.49 | 40 |
| 191 | QSESQLSGSVGMIEMDLASGR | 3 | y8 | 19.7 | 728.01 | 878.4 | 40 |
| 192 | QSESQLSGSVGMIEMDLASGR | 3 | y7 | 19.7 | 728.01 | 749.36 | 40 |
| 193 | SQLQLLQWMVDDR | 2 | y9 | 26.3 | 816.41 | 1175.6 | 41 |
| 194 | SQLQLLQWMVDDR | 2 | y8 | 26.3 | 816.41 | 1062.5 | 41 |
| 195 | SQLQLLQWMVDDR | 2 | y7 | 26.3 | 816.41 | 949.42 | 41 |
| 196 | SVLPAGWFIADK | 2 | y9 | 22.9 | 652.36 | 1004.5 | 34 |
| 197 | SVLPAGWFIADK | 2 | y8 | 22.9 | 652.36 | 907.47 | 34 |
| 198 | SVLPAGWFIADK | 2 | y7 | 22.9 | 652.36 | 836.43 | 34 |
| 199 | SVLPAGWFIADR | 2 | y9 | 23 | 666.36 | 1032.5 | 34 |
| 200 | SVLPAGWFIADR | 2 | y8 | 23 | 666.36 | 935.47 | 34 |
| 201 | SVLPAGWFIADR | 2 | y7 | 23 | 666.36 | 864.44 | 34 |
| 202 | SVLSAGWFIADK | 2 | y9 | 22.7 | 647.35 | 994.5 | 33 |
| 203 | SVLSAGWFIADK | 2 | y8 | 22.7 | 647.35 | 907.47 | 33 |
| 204 | SVLSAGWFIADK | 2 | y7 | 22.7 | 647.35 | 836.43 | 33 |
| 205 | TGAAER | 2 | y5 | 4.8 | 302.66 | 503.26 | 18 |
| 206 | TGAAER | 2 | y4 | 4.8 | 302.66 | 446.24 | 18 |
| 207 | TGAAER | 2 | y3 | 4.8 | 302.66 | 375.2 | 18 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 208 | TGAAK | 2 | y4 | 6 | 224.13 | 346.21 | 15 |
| 209 | TGAAK | 2 | y3 | 6 | 224.13 | 289.19 | 15 |
| 210 | TGAAK | 2 | b4 | 6 | 224.13 | 301.15 | 15 |
| 211 | TGAGER | 2 | y5 | 4.9 | 295.65 | 489.24 | 18 |
| 212 | TGAGER | 2 | y4 | 4.9 | 295.65 | 432.22 | 18 |
| 213 | TGAGER | 2 | y3 | 4.9 | 295.65 | 361.18 | 18 |
| 214 | TGAGK | 2 | y4 | 6.1 | 217.12 | 332.19 | 15 |
| 215 | TGAGK | 2 | y3 | 6.1 | 217.12 | 275.17 | 15 |
| 216 | TGAGK | 2 | b4 | 6.1 | 217.12 | 287.13 | 15 |
| 217 | TGASER | 2 | y5 | 4.5 | 310.65 | 519.25 | 19 |
| 218 | TGASER | 2 | y4 | 4.5 | 310.65 | 462.23 | 19 |
| 219 | TGASER | 2 | y3 | 4.5 | 310.65 | 391.19 | 19 |
| 220 | TGASK | 2 | y4 | 5.8 | 232.13 | 362.2 | 15 |
| 221 | TGASK | 2 | y3 | 5.8 | 232.13 | 305.18 | 15 |
| 222 | TGASK | 2 | b4 | 5.8 | 232.13 | 317.15 | 15 |
| 223 | TGASR | 2 | y4 | 5.8 | 246.13 | 390.21 | 16 |
| 224 | TGASR | 2 | y3 | 5.8 | 246.13 | 333.19 | 16 |
| 225 | TGASR | 2 | y2 | 5.8 | 246.13 | 262.15 | 16 |
| 226 | TLTAWCADER | 2 | y9 | 15.9 | 611.78 | 1121.5 | 32 |
| 227 | TLTAWCADER | 2 | y8 | 15.9 | 611.78 | 1008.4 | 32 |
| 228 | TLTAWCADER | 2 | y7 | 15.9 | 611.78 | 907.37 | 32 |
| 229 | TLTAWHADER | 2 | y9 | 14.4 | 600.29 | 1098.5 | 31 |
| 230 | TLTAWHADER | 2 | y8 | 14.4 | 600.29 | 985.45 | 31 |
| 231 | TLTAWHADER | 2 | y7 | 14.4 | 600.29 | 884.4 | 31 |
| 232 | TLTAWR | 2 | y5 | 15 | 374.21 | 646.37 | 21 |
| 233 | TLTAWR | 2 | y4 | 15 | 374.21 | 533.28 | 21 |
| 234 | TLTAWR | 2 | y3 | 15 | 374.21 | 432.24 | 21 |
| 235 | TVGGPAGLTAFLR | 2 | y9 | 19.7 | 630.36 | 945.55 | 33 |
| 236 | TVGGPAGLTAFLR | 2 | y8 | 19.7 | 630.36 | 848.5 | 33 |
| 237 | TVGGPAGLTAFLR | 2 | y7 | 19.7 | 630.36 | 777.46 | 33 |
| 238 | TVVIYLR | 2 | y6 | 17.4 | 432.27 | 762.49 | 24 |
| 239 | TVVIYLR | 2 | y5 | 17.4 | 432.27 | 663.42 | 24 |
| 240 | TVVIYLR | 2 | y4 | 17.4 | 432.27 | 564.35 | 24 |
| 241 | VAGPLIR | 2 | y6 | 14.1 | 363.24 | 626.4 | 21 |
| 242 | VAGPLIR | 2 | y5 | 14.1 | 363.24 | 555.36 | 21 |
| 243 | VAGPLIR | 2 | y4 | 14.1 | 363.24 | 498.34 | 21 |
| 244 | VALCGAVLAR | 2 | y9 | 17.2 | 515.3 | 930.52 | 28 |
| 245 | VALCGAVLAR | 2 | y8 | 17.2 | 515.3 | 859.48 | 28 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 246 | VALCGAVLAR | 2 | y7 | 17.2 | 515.3 | 746.4 | 28 |
| 247 | VDAGDEQLER | 2 | y9 | 10.9 | 566.27 | 1032.5 | 30 |
| 248 | VDAGDEQLER | 2 | y8 | 10.9 | 566.27 | 917.43 | 30 |
| 249 | VDAGDEQLER | 2 | y7 | 10.9 | 566.27 | 846.4 | 30 |
| 250 | VDAGDK | 2 | y5 | 4.1 | 302.65 | 505.23 | 18 |
| 251 | VDAGDK | 2 | y4 | 4.1 | 302.65 | 390.2 | 18 |
| 252 | VDAGDK | 2 | y3 | 4.1 | 302.65 | 319.16 | 18 |
| 253 | VGMIEMDLASGR | 2 | y9 | 18.7 | 639.81 | 991.49 | 33 |
| 254 | VGMIEMDLASGR | 2 | y8 | 18.7 | 639.81 | 878.4 | 33 |
| 255 | VGMIEMDLASGR | 2 | y7 | 18.7 | 639.81 | 749.36 | 33 |
| 256 | VGMIEMDLASR | 2 | y9 | 18.7 | 611.3 | 1065.5 | 32 |
| 257 | VGMIEMDLASR | 2 | y8 | 18.7 | 611.3 | 934.47 | 32 |
| 258 | VGMIEMDLASR | 2 | y7 | 18.7 | 611.3 | 821.38 | 32 |
| 259 | VGMIEMDLASSR | 2 | y9 | 18.4 | 654.82 | 1021.5 | 34 |
| 260 | VGMIEMDLASSR | 2 | y8 | 18.4 | 654.82 | 908.41 | 34 |
| 261 | VGMIEMDLASSR | 2 | y7 | 18.4 | 654.82 | 779.37 | 34 |
| 262 | VLLCGAVLAR | 2 | y9 | 19.3 | 536.32 | 972.57 | 29 |
| 263 | VLLCGAVLAR | 2 | y8 | 19.3 | 536.32 | 859.48 | 29 |
| 264 | VLLCGAVLAR | 2 | y7 | 19.3 | 536.32 | 746.4 | 29 |
| 265 | VVLCGAMLAR | 2 | y8 | 18.1 | 545.3 | 891.45 | 29 |
| 266 | VVLCGAMLAR | 2 | y7 | 18.1 | 545.3 | 778.37 | 29 |
| 267 | VVLCGAMLAR | 2 | y6 | 18.1 | 545.3 | 618.34 | 29 |
| 268 | VVLCGAVLAR | 2 | y9 | 18 | 529.31 | 958.55 | 28 |
| 269 | VVLCGAVLAR | 2 | y8 | 18 | 529.31 | 859.48 | 28 |
| 270 | VVLCGAVLAR | 2 | y7 | 18 | 529.31 | 746.4 | 28 |
| 271 | VVLCGTVLAR | 2 | y9 | 16.6 | 544.32 | 988.56 | 29 |
| 272 | VVLCGTVLAR | 2 | y8 | 16.6 | 544.32 | 889.49 | 29 |
| 273 | VVLCGTVLAR | 2 | y7 | 16.6 | 544.32 | 776.41 | 29 |
| 274 | WETDR | 2 | y4 | 9.8 | 353.66 | 520.24 | 21 |
| 275 | WETDR | 2 | y3 | 9.8 | 353.66 | 391.19 | 21 |
| 276 | WETDR | 2 | b4 | 9.8 | 353.66 | 532.2 | 21 |
| 277 | WETELNEAFPGDAR | 2 | y9 | 19 | 817.88 | 976.45 | 41 |
| 278 | WETELNEAFPGDAR | 2 | y8 | 19 | 817.88 | 862.41 | 41 |
| 279 | WETELNEAFPGDAR | 2 | y7 | 19 | 817.88 | 733.36 | 41 |
| 280 | WETELNEALPADAR | 2 | y9 | 18.9 | 807.89 | 956.48 | 41 |
| 281 | WETELNEALPADAR | 2 | y8 | 18.9 | 807.89 | 842.44 | 41 |
| 282 | WETELNEALPADAR | 2 | y7 | 18.9 | 807.89 | 713.39 | 41 |
| 283 | WETELNEALPGDAR | 2 | y9 | 18.5 | 800.88 | 942.46 | 40 |

TABLE 8-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 284 | WETELNEALPGDAR | 2 | y8 | 18.5 | 800.88 | 828.42 | 40 |
| 285 | WETELNEALPGDAR | 2 | y7 | 18.5 | 800.88 | 699.38 | 40 |
| 286 | WETELNEALSGDAR | 2 | y9 | 18 | 795.87 | 932.44 | 40 |
| 287 | WETELNEALSGDAR | 2 | y8 | 18 | 795.87 | 818.4 | 40 |
| 288 | WETELNEALSGDAR | 2 | y7 | 18 | 795.87 | 689.36 | 40 |
| 289 | WETELNEVLPGDAR | 2 | y9 | 19.4 | 814.9 | 970.5 | 41 |
| 290 | WETELNEVLPGDAR | 2 | y8 | 19.4 | 814.9 | 856.45 | 41 |
| 291 | WETELNEVLPGDAR | 2 | y7 | 19.4 | 814.9 | 727.41 | 41 |
| 292 | WETER | 2 | y4 | 10.4 | 360.67 | 534.25 | 21 |
| 293 | WETER | 2 | y3 | 10.4 | 360.67 | 405.21 | 21 |
| 294 | WETER | 2 | b4 | 10.4 | 360.67 | 546.22 | 21 |

The areas obtained for each of the transitions and for each of the microorganisms studied were measured. When the areas of the 3 transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 10

Identification of a Resistance to FOX Beta-Lactams

The samples corresponding to a species able to comprise a FOX resistance mechanism can be detected by employing the following method.

Each sample is treated according to example 5, then analysed according to example 6 by detecting the peptides from TABLE 9 instead of the peptides from TABLE 3.

TABLE 9

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 1 | AHYFNYGVANR | 2 | y9 | 15.5 | 656.32 | 1103.53 | 34 |
| 2 | AHYFNYGVANR | 2 | y8 | 15.5 | 656.32 | 940.46 | 34 |
| 3 | AHYFNYGVANR | 2 | y7 | 15.5 | 656.32 | 793.4 | 34 |
| 4 | AMGEQR | 2 | y5 | 5.3 | 346.16 | 620.28 | 20 |
| 5 | AMGEQR | 2 | y4 | 5.3 | 346.16 | 489.24 | 20 |
| 6 | AMGEQR | 2 | y3 | 5.3 | 346.16 | 432.22 | 20 |
| 7 | ESGQR | 2 | y4 | 4.3 | 288.64 | 447.23 | 18 |
| 8 | ESGQR | 2 | y3 | 4.3 | 288.64 | 360.2 | 18 |
| 9 | ESGQR | 2 | b4 | 4.3 | 288.64 | 402.16 | 18 |
| 10 | FAVPK | 2 | y4 | 11.3 | 281.17 | 414.27 | 17 |
| 11 | FAVPK | 2 | y3 | 11.3 | 281.17 | 343.23 | 17 |
| 12 | FAVPK | 2 | b4 | 11.3 | 281.17 | 415.23 | 17 |
| 13 | GGFELDDK | 2 | y7 | 14.5 | 440.71 | 823.38 | 24 |
| 14 | GGFELDDK | 2 | y6 | 14.5 | 440.71 | 766.36 | 24 |
| 15 | GGFELDDK | 2 | y5 | 14.5 | 440.71 | 619.29 | 24 |
| 16 | GIAIVMLANR | 2 | y9 | 19.3 | 529.31 | 1000.6 | 28 |

TABLE 9-continued

| Transition number | Peptide | Charge state of the precursor | first-generation fragment ion | Retention time (minutes) | (m/z) filtered in Q1 | (m/z) filtered in Q3 | Collision energy (eV) |
|---|---|---|---|---|---|---|---|
| 17 | GIAIVMLANR | 2 | y8 | 19.3 | 529.31 | 887.51 | 28 |
| 18 | GIAIVMLANR | 2 | y7 | 19.3 | 529.31 | 816.48 | 28 |
| 19 | IPGMAVAVLK | 2 | y9 | 18.1 | 499.81 | 885.52 | 27 |
| 20 | IPGMAVAVLK | 2 | y8 | 18.1 | 499.81 | 788.47 | 27 |
| 21 | IPGMAVAVLK | 2 | y7 | 18.1 | 499.81 | 731.45 | 27 |
| 22 | NYPIEAR | 2 | y6 | 12.2 | 431.72 | 748.4 | 24 |
| 23 | NYPIEAR | 2 | y5 | 12.2 | 431.72 | 585.34 | 24 |
| 24 | NYPIEAR | 2 | y4 | 12.2 | 431.72 | 488.28 | 24 |
| 25 | SWSPVYPAGTHR | 2 | y9 | 15.5 | 679.34 | 997.52 | 35 |
| 26 | SWSPVYPAGTHR | 2 | y8 | 15.5 | 679.34 | 900.47 | 35 |
| 27 | SWSPVYPAGTHR | 2 | y7 | 15.5 | 679.34 | 801.4 | 35 |
| 28 | TGSADLLK | 2 | y7 | 14 | 402.73 | 703.4 | 23 |
| 29 | TGSADLLK | 2 | y6 | 14 | 402.73 | 646.38 | 23 |
| 30 | TGSADLLK | 2 | y5 | 14 | 402.73 | 559.34 | 23 |
| 31 | TGSTGGFGAYVAFVPAR | 2 | y9 | 19.5 | 829.42 | 993.55 | 41 |
| 32 | TGSTGGFGAYVAFVPAR | 2 | y8 | 19.5 | 829.42 | 922.51 | 41 |
| 33 | TGSTGGFGAYVAFVPAR | 2 | y7 | 19.5 | 829.42 | 759.45 | 41 |
| 34 | TLTATLGAYAAVK | 2 | y9 | 17.2 | 640.37 | 893.51 | 33 |
| 35 | TLTATLGAYAAVK | 2 | y8 | 17.2 | 640.37 | 792.46 | 33 |
| 36 | TLTATLGAYAAVK | 2 | y7 | 17.2 | 640.37 | 679.38 | 33 |
| 37 | VSEQTLFEIGSVSK | 2 | y9 | 19.6 | 762.4 | 979.55 | 39 |
| 38 | VSEQTLFEIGSVSK | 2 | y8 | 19.6 | 762.4 | 866.46 | 39 |
| 39 | VSEQTLFEIGSVSK | 2 | y7 | 19.6 | 762.4 | 719.39 | 39 |
| 40 | VSQHAPWLK | 2 | y8 | 15.3 | 533.3 | 966.52 | 28 |
| 41 | VSQHAPWLK | 2 | y7 | 15.3 | 533.3 | 879.48 | 28 |
| 42 | VSQHAPWLK | 2 | y6 | 15.3 | 533.3 | 751.42 | 28 |
| 43 | VTPGVLAAEAYGIK | 2 | y9 | 18.4 | 694.89 | 935.52 | 36 |
| 44 | VTPGVLAAEAYGIK | 2 | y8 | 18.4 | 694.89 | 822.44 | 36 |
| 45 | VTPGVLAAEAYGIK | 2 | y7 | 18.4 | 694.89 | 751.4 | 36 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 11

Identification of a Resistance to TEM or CTX-M Beta-Lactams

The samples corresponding to a species able to comprise a TEM or CTX-M resistance mechanism can be detected by employing the following method.

Each sample is treated according to example 5, then analysed according to example 6 by detecting the peptides from TABLE 10 instead of the peptides from TABLE 3.

TABLE 10

| Transition number | Protein | Peptide | First-generation fragment ion | Charge state of the precursor | Clinical interest |
|---|---|---|---|---|---|
| 1 | CTX-M | AMAQTLR | y4 monocharged | 2 | 2be |
| 2 | CTX-M | AMAQTLR | y5 monocharged | 2 | 2be |
| 3 | CTX-M | AMAQTLR | y6 monocharged | 2 | 2be |
| 4 | CTX-M | AQLVTWLK | y5 monocharged | 2 | 2be |
| 5 | CTX-M | AQLVTWLK | y6 monocharged | 2 | 2be |
| 6 | CTX-M | AQLVTWLK | y7 monocharged | 2 | 2be |
| 7 | CTX-M | FAMCSTSK | y5 monocharged | 2 | 2be |
| 8 | CTX-M | FAMCSTSK | y6 monocharged | 2 | 2be |
| 9 | CTX-M | FAMCSTSK | y7 monocharged | 2 | 2be |
| 10 | CTX-M | LAALEK | y3 monocharged | 2 | 2be |
| 11 | CTX-M | LAALEK | y4 monocharged | 2 | 2be |
| 12 | CTX-M | LAALEK | y5 monocharged | 2 | 2be |
| 13 | CTX-M | LGVALINTADNSQILYR | y7 monocharged | 2 | 2be |
| 14 | CTX-M | LGVALINTADNSQILYR | y8 monocharged | 2 | 2be |
| 15 | CTX-M | LGVALINTADNSQILYR | y9 monocharged | 2 | 2be |
| 16 | CTX-M | NLTLGK | y3 monocharged | 2 | 2be |
| 17 | CTX-M | NLTLGK | y4 monocharged | 2 | 2be |
| 18 | CTX-M | NLTLGK | y5 monocharged | 2 | 2be |
| 19 | CTX-M | QSETQK | y3 monocharged | 2 | 2be |
| 20 | CTX-M | QSETQK | y4 monocharged | 2 | 2be |
| 21 | CTX-M | QSETQK | y5 monocharged | 2 | 2be |
| 22 | CTX-M | SDLVNYNPIAEK | y7 monocharged | 2 | 2be |
| 23 | CTX-M | SDLVNYNPIAEK | y8 monocharged | 2 | 2be |
| 24 | CTX-M | SDLVNYNPIAEK | y9 monocharged | 2 | 2be |
| 25 | CTX-M | TEPTLNTAIPGDPR | y7 monocharged | 2 | 2be |
| 26 | CTX-M | TEPTLNTAIPGDPR | y8 monocharged | 2 | 2be |
| 27 | CTX-M | TEPTLNTAIPGDPR | y9 monocharged | 2 | 2be |
| 28 | CTX-M | VMAAAAVLK | y6 monocharged | 2 | 2be |
| 29 | CTX-M | VMAAAAVLK | y7 monocharged | 2 | 2be |
| 30 | CTX-M | VMAAAAVLK | y8 monocharged | 2 | 2be |
| 31 | TEM | DAEDQLGAR | y5 monocharged | 2 | TEM |
| 32 | TEM | DAEDQLGAR | y6 monocharged | 2 | TEM |
| 33 | TEM | DAEDQLGAR | y7 monocharged | 2 | TEM |
| 34 | TEM | DTTMPAAMATTLR | y7 monocharged | 2 | TEM |
| 35 | TEM | DTTMPAAMATTLR | y8 monocharged | 2 | TEM |
| 36 | TEM | DTTMPAAMATTLR | y9 monocharged | 2 | TEM |

TABLE 10-continued

| Transition number | Protein | Peptide | First-generation fragment ion | Charge state of the precursor | Clinical interest |
|---|---|---|---|---|---|
| 37 | TEM | DTTTPAAMATTLR | y7 monocharged | 2 | TEM |
| 38 | TEM | DTTTPAAMATTLR | y9 dicharged | 2 | TEM |
| 39 | TEM | DTTTPAAMATTLR | y9 monocharged | 2 | TEM |
| 40 | TEM | EPELNEAIPNDER | y5 monocharged | 2 | TEM |
| 41 | TEM | EPELNEAIPNDER | y7 monocharged | 2 | TEM |
| 42 | TEM | EPELNEAIPNDER | y8 monocharged | 2 | TEM |
| 43 | TEM | GIIAALGPDGKPSR | y7 monocharged | 2 | TEM |
| 44 | TEM | GIIAALGPDGKPSR | y8 monocharged | 2 | TEM |
| 45 | TEM | GIIAALGPDGKPSR | y9 monocharged | 2 | TEM |
| 46 | TEM | GSCGIIAALGPDGKPSR | y7 monocharged | 2 | 2br |
| 47 | TEM | GSCGIIAALGPDGKPSR | y8 monocharged | 2 | 2br |
| 48 | TEM | GSCGIIAALGPDGKPSR | y9 monocharged | 2 | 2br |
| 49 | TEM | GSSGIIAALGPDGKPSR | y7 monocharged | 2 | TEM |
| 50 | TEM | GSSGIIAALGPDGKPSR | y8 monocharged | 2 | TEM |
| 51 | TEM | GSSGIIAALGPDGKPSR | y9 monocharged | 2 | TEM |
| 52 | TEM | HLTDGMTVR | y4 monocharged | 2 | TEM |
| 53 | TEM | HLTDGMTVR | y7 monocharged | 2 | TEM |
| 54 | TEM | HLTDGMTVR | y8 monocharged | 2 | TEM |
| 55 | TEM | IHYSQNDLVEYSPVTEK | y6 monocharged | 3 | TEM |
| 56 | TEM | IHYSQNDLVEYSPVTEK | y7 monocharged | 3 | TEM |
| 57 | TEM | IHYSQNDLVEYSPVTEK | y8 monocharged | 3 | TEM |
| 58 | TEM | IHYSQNDLVK | y7 monocharged | 2 | 2be |
| 59 | TEM | IHYSQNDLVK | y8 monocharged | 2 | 2be |
| 60 | TEM | IHYSQNDLVK | y9 dicharged | 2 | 2be |
| 61 | TEM | ILESFRPEER | b6 monocharged | 2 | TEM |
| 62 | TEM | ILESFRPEER | b8 monocharged | 2 | TEM |
| 63 | TEM | ILESFRPEER | y7 dicharged | 2 | TEM |
| 64 | TEM | LDHWEPELNEAIPNDER | y5 monocharged | 3 | 2be |
| 65 | TEM | LDHWEPELNEAIPNDER | y6 monocharged | 3 | 2be |
| 66 | TEM | LDHWEPELNEAIPNDER | y7 monocharged | 3 | 2be |
| 67 | TEM | LDSWEPELNEAIPNDER | y5 monocharged | 3 | 2be |
| 68 | TEM | LDSWEPELNEAIPNDER | y6 monocharged | 3 | 2be |
| 69 | TEM | LDSWEPELNEAIPNDER | y7 monocharged | 3 | 2be |
| 70 | TEM | LLTGELLTLASR | y6 monocharged | 2 | TEM |
| 71 | TEM | LLTGELLTLASR | y7 monocharged | 2 | TEM |
| 72 | TEM | LLTGELLTLASR | y9 monocharged | 2 | TEM |
| 73 | TEM | QIAEIGASLIK | y7 monocharged | 2 | TEM |
| 74 | TEM | QIAEIGASLIK | y8 monocharged | 2 | TEM |

TABLE 10-continued

| Transition number | Protein | Peptide | First-generation fragment ion | Charge state of the precursor | Clinical interest |
|---|---|---|---|---|---|
| 75 | TEM | QIAEIGASLIK | y9 monocharged | 2 | TEM |
| 76 | TEM | QQLIDWMEADK | y5 monocharged | 2 | TEM |
| 77 | TEM | QQLIDWMEADK | y6 monocharged | 2 | TEM |
| 78 | TEM | QQLIDWMEADK | y7 monocharged | 2 | TEM |
| 79 | TEM | VAGPLLR | y4 monocharged | 2 | TEM |
| 80 | TEM | VAGPLLR | y5 monocharged | 2 | TEM |
| 81 | TEM | VAGPLLR | y6 monocharged | 2 | TEM |
| 82 | TEM | VDAGQEQLGR | y5 monocharged | 2 | TEM |
| 83 | TEM | VDAGQEQLGR | y7 monocharged | 2 | TEM |
| 84 | TEM | VDAGQEQLGR | y8 monocharged | 2 | TEM |
| 85 | TEM | VGYIELDLNSGK | y7 monocharged | 2 | TEM |
| 86 | TEM | VGYIELDLNSGK | y8 monocharged | 2 | TEM |
| 87 | TEM | VGYIELDLNSGK | y9 monocharged | 2 | TEM |
| 88 | TEM | WEPELNEAIPNDER | y12 dicharged | 2 | TEM |
| 89 | TEM | WEPELNEAIPNDER | y5 monocharged | 2 | TEM |
| 90 | TEM | WEPELNEAIPNDER | y7 monocharged | 2 | TEM |
| 91 | TEM | YSPVTEK | y4 monocharged | 2 | 2be |
| 92 | TEM | YSPVTEK | y5 monocharged | 2 | 2be |
| 93 | TEM | YSPVTEK | y6 monocharged | 2 | 2be |

In the clinical interest column, the entries TEM, 2b, 2br, 2be and 2ber correspond to the same meanings as in TABLE 4.

The transitions mentioned in TABLE 10 are detected by using the parameters set out in TABLE 11.

TABLE 11

| Transition number | Retention time (minutes) | (m/z) filtered in Q1 | (m/z) filtered in Q3 | Collision energy (eV) | Positivity threshold |
|---|---|---|---|---|---|
| 1 | 12.1 | 395.72 | 517.31 | 22 | 2500 |
| 2 | 12.1 | 395.72 | 588.35 | 22 | 2500 |
| 3 | 12.1 | 395.72 | 719.39 | 22 | 2500 |
| 4 | 21 | 479.79 | 646.39 | 26 | 2500 |
| 5 | 21 | 479.79 | 759.48 | 26 | 2500 |
| 6 | 21 | 479.79 | 887.53 | 26 | 2500 |
| 7 | 11.1 | 466.2 | 582.26 | 26 | 2500 |
| 8 | 11.1 | 466.2 | 713.3 | 26 | 2500 |
| 9 | 11.1 | 466.2 | 784.33 | 26 | 2500 |
| 10 | 11 | 322.7 | 389.24 | 19 | 2500 |
| 11 | 11 | 322.7 | 460.28 | 19 | 2500 |
| 12 | 11 | 322.7 | 531.31 | 19 | 2500 |
| 13 | 21.1 | 931.01 | 893.48 | 46 | 2500 |
| 14 | 21.1 | 931.01 | 1008.51 | 46 | 2500 |
| 15 | 21.1 | 931.01 | 1079.55 | 46 | 2500 |
| 16 | 12.2 | 323.2 | 317.22 | 19 | 2500 |
| 17 | 12.2 | 323.2 | 418.27 | 19 | 2500 |
| 18 | 12.2 | 323.2 | 531.35 | 19 | 2500 |
| 19 | 3.7 | 360.68 | 376.22 | 21 | 2500 |
| 20 | 3.7 | 360.68 | 505.26 | 21 | 2500 |
| 21 | 3.7 | 360.68 | 592.29 | 21 | 2500 |
| 22 | 17.1 | 681.85 | 834.44 | 35 | 2500 |
| 23 | 17.1 | 681.85 | 948.48 | 35 | 2500 |
| 24 | 17.1 | 681.85 | 1047.55 | 35 | 2500 |
| 25 | 15.6 | 741.38 | 725.39 | 38 | 2500 |
| 26 | 15.6 | 741.38 | 826.44 | 38 | 2500 |
| 27 | 15.6 | 741.38 | 940.48 | 38 | 2500 |
| 28 | 15.3 | 437.26 | 572.38 | 24 | 2500 |
| 29 | 15.3 | 437.26 | 643.41 | 24 | 2500 |
| 30 | 15.3 | 437.26 | 774.45 | 24 | 2500 |
| 31 | 10.5 | 487.73 | 544.32 | 26 | 2500 |
| 32 | 10.5 | 487.73 | 659.35 | 26 | 2500 |
| 33 | 10.5 | 487.73 | 788.39 | 26 | 2500 |
| 34 | 17.6 | 690.34 | 763.61 | 35 | 2500 |
| 35 | 17.6 | 690.34 | 834.45 | 35 | 2500 |
| 36 | 17.6 | 690.34 | 931.5 | 35 | 2500 |
| 37 | 16.1 | 675.34 | 763.41 | 35 | 2500 |
| 38 | 16.1 | 675.34 | 466.25 | 35 | 2500 |
| 39 | 16.1 | 675.34 | 931.5 | 35 | 2500 |
| 40 | 14.9 | 763.36 | 630.28 | 39 | 2500 |
| 41 | 14.9 | 763.36 | 814.41 | 39 | 2500 |
| 42 | 14.9 | 763.36 | 943.45 | 39 | 2500 |
| 43 | 15.5 | 676.39 | 756.4 | 35 | 2500 |
| 44 | 15.5 | 676.39 | 813.42 | 35 | 2500 |
| 45 | 15.5 | 676.39 | 926.51 | 35 | 2500 |
| 46 | 16.5 | 828.43 | 756.4 | 41 | 2500 |
| 47 | 16.5 | 828.43 | 813.42 | 41 | 2500 |
| 48 | 16.5 | 828.43 | 926.51 | 41 | 2500 |
| 49 | 16.1 | 791.93 | 756.4 | 40 | 2500 |
| 50 | 16.1 | 791.93 | 813.42 | 40 | 2500 |
| 51 | 16.1 | 791.93 | 926.51 | 40 | 2500 |

TABLE 11-continued

| Transition number | Retention time (minutes) | (m/z) filtered in Q1 | (m/z) filtered in Q3 | Collision energy (eV) | Positivity threshold |
|---|---|---|---|---|---|
| 52 | 12 | 515.26 | 506.28 | 28 | 2500 |
| 53 | 12 | 515.26 | 779.37 | 28 | 2500 |
| 54 | 12 | 515.26 | 892.46 | 28 | 2500 |
| 55 | 16.6 | 674.67 | 660.36 | 38 | 2500 |
| 56 | 16.6 | 674.67 | 823.42 | 38 | 2500 |
| 57 | 16.6 | 674.67 | 952.46 | 38 | 2500 |
| 58 | 12.5 | 608.82 | 803.43 | 32 | 2500 |
| 59 | 12.5 | 608.82 | 966.49 | 32 | 2500 |
| 60 | 12.5 | 608.82 | 552.28 | 32 | 2500 |
| 61 | 14.6 | 638.34 | 746.42 | 33 | 2500 |
| 62 | 14.6 | 638.34 | 972.51 | 33 | 2500 |
| 63 | 14.6 | 638.34 | 460.73 | 33 | 2500 |
| 64 | 18 | 692.99 | 630.28 | 39 | 2500 |
| 65 | 18 | 692.99 | 743.37 | 39 | 2500 |
| 66 | 18 | 692.99 | 814.41 | 39 | 2500 |
| 67 | 19.5 | 676.32 | 630.28 | 38 | 2500 |
| 68 | 19.5 | 676.32 | 743.37 | 38 | 2500 |
| 69 | 19.5 | 676.32 | 814.41 | 38 | 2500 |
| 70 | 22.5 | 643.89 | 660.4 | 33 | 2500 |
| 71 | 22.5 | 643.89 | 773.49 | 33 | 2500 |
| 72 | 22.5 | 643.89 | 959.55 | 33 | 2500 |
| 73 | 18.8 | 571.84 | 701.46 | 30 | 2500 |
| 74 | 18.8 | 571.84 | 830.5 | 30 | 2500 |
| 75 | 18.8 | 571.84 | 901.54 | 30 | 2500 |
| 76 | 20.1 | 688.83 | 593.26 | 35 | 2500 |
| 77 | 20.1 | 688.83 | 779.34 | 35 | 2500 |
| 78 | 20.1 | 688.83 | 894.37 | 35 | 2500 |
| 79 | 14.1 | 363.24 | 498.34 | 21 | 2500 |
| 80 | 14.1 | 363.24 | 555.36 | 21 | 2500 |
| 81 | 14.1 | 363.24 | 626.4 | 21 | 2500 |
| 82 | 10.6 | 536.77 | 602.38 | 29 | 2500 |
| 83 | 10.6 | 536.77 | 787.41 | 29 | 2500 |
| 84 | 10.6 | 536.77 | 858.44 | 29 | 2500 |
| 85 | 18.8 | 654.35 | 746.4 | 34 | 2500 |
| 86 | 18.8 | 654.35 | 875.45 | 34 | 2500 |
| 87 | 18.8 | 654.35 | 988.53 | 34 | 2500 |
| 88 | 18 | 856.4 | 698.84 | 43 | 2500 |
| 89 | 18 | 856.4 | 630.28 | 43 | 2500 |
| 90 | 18 | 856.4 | 814.41 | 43 | 2500 |
| 91 | 9.8 | 412.21 | 476.27 | 23 | 2500 |
| 92 | 9.8 | 412.21 | 573.32 | 23 | 2500 |
| 93 | 9.8 | 412.21 | 660.36 | 23 | 2500 |

When the areas of at least two transitions of the same peptide are greater than or equal to the positivity threshold described in TABLE 11, the detection of the peptide is considered to be positive. When more than two transitions of the same peptide comprise an area less than the positivity threshold described in TABLE 11, the corresponding peptide is considered non-detected.

A sample contains bacteria which express the TEM protein, when at least one peptide corresponding to the TEM resistance mechanism is detected. These bacteria are resistant to penicillins.

A sample contains bacteria which express the TEM protein, phenotype 2b, when at least one peptide corresponding to the TEM resistance mechanism clinical interest 2b is detected. These bacteria are only resistant to penicillins.

A sample contains bacteria which express the TEM protein, phenotype 2br, when at least one peptide corresponding to the TEM resistance mechanism clinical interest 2br is detected. These bacteria are resistant to penicillins associated with an inhibitor of the clavulanic acid and tazobactam type.

A sample contains bacteria which express the CTX-M protein or the TEM protein, phenotype 2be, when at least one peptide corresponding to the CTX-M or TEM resistance mechanism clinical interest 2be is detected. These bacteria are resistant to penicillins, to cephalosporins and to monobactams.

A sample contains bacteria which express the TEM protein, phenotype 2ber, when at least one peptide corresponding to the TEM resistance mechanism clinical interest 2ber, is detected. These bacteria are resistant to penicillins, to cephalosporins and to monobactams, and are insensitive to inhibition by clavulanic acid, sulfobactam or tazobactam.

EXAMPLE 12

Identification of a Resistance to PER Beta-Lactams

Samples Sam74 to Sam78 are identified according to one of the methods described in examples 1, 3 or 4. The identification of the species is set out in TABLE 12.

TABLE 12

| Names | Species |
|---|---|
| Ech74 | A. baumannii |
| Ech75 | A. baumannii |
| Ech76 | P. aeruginosa |
| Ech77 | P. aeruginosa |
| Ech78 | P. aeruginosa |

Samples Sam74 to Sam78 correspond to a species able to comprise a PER resistance mechanism. Each sample is treated according to example 5, then analysed according to example 6 by detecting the peptides from TABLE 13 instead of the peptides from TABLE 3.

TABLE 13

| Transition number | Peptide | Retention time (minutes) | (m/z) filtered in Q1 | (m/z) filtered in Q3 | Collision energy (eV) | positivity threshold |
|---|---|---|---|---|---|---|
| 1 | AAAQLLR | 12.91 | 371.73 | 401.29 | 16.9 | 2000 |
| 2 | AAAQLLR | 12.89 | 371.73 | 529.35 | 16.9 | 2000 |
| 3 | AAAQLLR | 12.91 | 371.73 | 600.38 | 16.9 | 2000 |
| 4 | AAAQVLQK | 10.24 | 414.75 | 487.32 | 19.4 | 2000 |
| 5 | AAAQVLQK | 10.24 | 414.75 | 615.38 | 19.4 | 2000 |
| 6 | AAAQVLQK | 10.18 | 414.75 | 686.42 | 19.4 | 2000 |
| 7 | AAVLQNTWSPMMK | 19.35 | 738.87 | 506.25 | 37.9 | 2000 |
| 8 | AAVLQNTWSPMMK | 19.35 | 738.87 | 593.28 | 37.9 | 2000 |

TABLE 13-continued

| Transition number | Peptide | Retention time (minutes) | (m/z) filtered in Q1 | (m/z) filtered in Q3 | Collision energy (eV) | positivity threshold |
|---|---|---|---|---|---|---|
| 9 | AAVLQNTWSPMMK | 19.35 | 738.87 | 994.45 | 37.9 | 2000 |
| 10 | EQIESIVIGK | 17.24 | 558.32 | 317.22 | 27.6 | 2000 |
| 11 | EQIESIVIGK | 17.26 | 558.32 | 616.40 | 27.6 | 2000 |
| 12 | EQIESIVIGK | 17.24 | 558.32 | 745.45 | 27.6 | 2000 |
| 13 | EQIETIVTGK | 15.48 | 559.31 | 305.18 | 27.6 | 2000 |
| 14 | EQIETIVTGK | 15.48 | 559.31 | 618.38 | 27.6 | 2000 |
| 15 | EQIETIVTGK | 15.48 | 559.31 | 747.43 | 27.6 | 2000 |
| 16 | ETEVVANEAQMHADDQVQYK | 14.17 | 769.02 | 838.87 | 30.9 | 5000 |
| 17 | ETEVVANEAQMHADDQVQYK | 14.17 | 769.02 | 874.39 | 30.9 | 5000 |
| 18 | ETEVVANEAQMHADDQVQYK | 14.17 | 769.02 | 923.92 | 30.9 | 5000 |
| 19 | FPMQSVFK | 19.09 | 492.26 | 418.72 | 23.8 | 2000 |
| 20 | FPMQSVFK | 19.09 | 492.26 | 739.38 | 23.8 | 2000 |
| 21 | FPMQSVFK | 19.07 | 492.26 | 836.43 | 23.8 | 2000 |
| 22 | GAAEILK | 12.66 | 351.21 | 322.70 | 15.8 | 2000 |
| 23 | GAAEILK | 12.65 | 351.21 | 502.32 | 15.8 | 2000 |
| 24 | GAAEILK | 12.65 | 351.21 | 573.36 | 15.8 | 2000 |
| 25 | GLLPAGTIVAHK | 16.8 | 588.86 | 447.26 | 29.3 | 2000 |
| 26 | GLLPAGTIVAHK | 16.8 | 588.86 | 503.81 | 29.3 | 2000 |
| 27 | GLLPAGTIVAHK | 16.82 | 588.86 | 893.52 | 29.3 | 2000 |
| 28 | GLLPAGTVVAHK | 15.73 | 581.85 | 440.26 | 28.9 | 2000 |
| 29 | GLLPAGTVVAHK | 15.73 | 581.85 | 496.80 | 28.9 | 2000 |
| 30 | GLLPAGTVVAHK | 15.75 | 581.85 | 879.51 | 28.9 | 2000 |
| 31 | GQIESIVIGK | 16.8 | 522.31 | 616.40 | 25.5 | 5000 |
| 32 | GQIESIVIGK | 16.8 | 522.31 | 745.45 | 25.5 | 5000 |
| 33 | GQIESIVIGK | 16.8 | 522.31 | 858.53 | 25.5 | 5000 |
| 34 | LDLNK | 10.5 | 301.68 | 342.20 | 12.9 | 2000 |
| 35 | LDLNK | 10.5 | 301.68 | 374.24 | 12.9 | 2000 |
| 36 | LDLNK | 10.52 | 301.68 | 489.27 | 12.9 | 2000 |
| 37 | LDLNQSVTVNR | 15.11 | 629.84 | 338.19 | 31.6 | 2000 |
| 38 | LDLNQSVTVNR | 15.11 | 629.84 | 489.28 | 31.6 | 2000 |
| 39 | LDLNQSVTVNR | 15.11 | 629.84 | 675.38 | 31.6 | 2000 |
| 40 | LDLNQTVIVNR | 17.29 | 642.87 | 501.31 | 32.4 | 2000 |
| 41 | LDLNQTVIVNR | 17.29 | 642.87 | 600.38 | 32.4 | 2000 |
| 42 | LDLNQTVIVNR | 17.28 | 642.87 | 701.43 | 32.4 | 2000 |
| 43 | LHLAMLVLHQVDQGK | 19.84 | 567.99 | 568.83 | 24.7 | 2000 |
| 44 | LHLAMLVLHQVDQGK | 19.84 | 567.99 | 669.86 | 24.7 | 2000 |
| 45 | LHLAMLVLHQVDQGK | 19.84 | 567.99 | 726.41 | 24.7 | 2000 |
| 46 | MHLAMLVLHQVDQGK | 19.35 | 573.97 | 332.19 | 24.9 | 2000 |

TABLE 13-continued

| Transition number | Peptide | Retention time (minutes) | (m/z) filtered in Q1 | (m/z) filtered in Q3 | Collision energy (eV) | positivity threshold |
|---|---|---|---|---|---|---|
| 47 | MHLAMLVLHQVDQGK | 19.35 | 573.97 | 669.86 | 24.9 | 2000 |
| 48 | MHLAMLVLHQVDQGK | 19.35 | 573.97 | 726.41 | 24.9 | 2000 |
| 49 | NWTSMK | 12.59 | 383.68 | 365.19 | 17.6 | 2000 |
| 50 | NWTSMK | 12.59 | 383.68 | 466.23 | 17.6 | 2000 |
| 51 | NWTSMK | 12.61 | 383.68 | 652.31 | 17.6 | 2000 |
| 52 | QLSETSQALLWK | 18.84 | 702.38 | 1162.61 | 35.8 | 2000 |
| 53 | QLSETSQALLWK | 18.84 | 702.38 | 446.28 | 35.8 | 2000 |
| 54 | QLSETSQALLWK | 18.84 | 702.38 | 845.49 | 35.8 | 2000 |
| 55 | TGTSGIK | 3.31 | 332.19 | 404.25 | 14.7 | 2000 |
| 56 | TGTSGIK | 3.29 | 332.19 | 505.30 | 14.7 | 2000 |
| 57 | TGTSGIK | 3.23 | 332.19 | 562.32 | 14.7 | 2000 |
| 58 | TGTSGVR | 1.56 | 339.18 | 418.24 | 15.1 | 2000 |
| 59 | TGTSGVR | 1.56 | 339.18 | 519.29 | 15.1 | 2000 |
| 60 | TGTSGVR | 1.56 | 339.18 | 576.31 | 15.1 | 2000 |
| 61 | TNEAIIAQVAQAAYQFELK | 26.27 | 703.37 | 1168.60 | 28.9 | 2000 |
| 62 | TNEAIIAQVAQAAYQFELK | 26.21 | 703.37 | 827.43 | 28.9 | 2000 |
| 63 | TNEAIIAQVAQAAYQFELK | 26.25 | 703.37 | 898.47 | 28.9 | 2000 |
| 64 | TNEAIIAQVAQTAYQFELK | 25.39 | 713.38 | 1198.61 | 29.2 | 2000 |
| 65 | TNEAIIAQVAQTAYQFELK | 25.37 | 713.38 | 827.43 | 29.2 | 2000 |
| 66 | TNEAIIAQVAQTAYQFELK | 25.37 | 713.38 | 898.47 | 29.2 | 2000 |
| 67 | TQLSETSQALLWK | 19.41 | 502.27 | 559.36 | 38.7 | 2000 |
| 68 | TQLSETSQALLWK | 19.41 | 502.27 | 630.40 | 22.7 | 2000 |
| 69 | TQLSETSQALLWK | 19.43 | 752.90 | 1162.61 | 22.7 | 2000 |
| 70 | TVAVNR | 7.08 | 330.20 | 388.23 | 14.6 | 2000 |
| 71 | TVAVNR | 7.08 | 330.20 | 459.27 | 14.6 | 2000 |
| 72 | TVAVNR | 7.05 | 330.20 | 558.34 | 14.6 | 2000 |
| 73 | VLQNTWAPIMK | 19.32 | 650.86 | 488.29 | 32.8 | 2000 |
| 74 | VLQNTWAPIMK | 19.3 | 650.86 | 559.33 | 32.8 | 2000 |
| 75 | VLQNTWAPIMK | 19.3 | 650.86 | 745.41 | 32.8 | 2000 |
| 76 | WMVETTTGPER | 15.5 | 653.81 | 761.38 | 33 | 2000 |
| 77 | WMVETTTGPER | 15.48 | 653.81 | 890.42 | 33 | 2000 |
| 78 | WMVETTTGPER | 15.48 | 653.81 | 989.49 | 33 | 2000 |
| 79 | WMVETTTGPQR | 15.19 | 653.32 | 457.25 | 33 | 2000 |
| 80 | WMVETTTGPQR | 15.19 | 653.32 | 889.44 | 33 | 2000 |
| 81 | WMVETTTGPQR | 15.23 | 653.32 | 988.51 | 33 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 40.00 psi |
| Heating gas: | 40.00 psi |
| Collision gas which induces dissociation: | 9.00 psi |
| Dynamic filling: | activated |
| Declustering potential (DP): | 100.00 V |
| Entry potential before Q0 (EP): | 10.00 V |
| Collision cell exit potential (CXP): | 15 V |
| Total cycle time: | 1 sec |
| Detection window: | 240 sec |

The areas obtained for each of the transitions and for each of the microorganisms studied were measured. When the areas of the transitions are greater than or equal to the positivity threshold described in TABLE 13, the detection of the transition is considered to be positive and is labelled "1" in TABLE 14. When a transition has an area less than the positivity threshold described in TABLE 13, the transition is considered non-detected and is labelled "0" in TABLE 14.

For a given peptide, when at least 3 transitions are labelled "1", the peptide is considered as being detected.

TABLE 14

| Transition number | Sam74 | Sam75 | Sam76 | Sam77 | Sam78 |
|---|---|---|---|---|---|
| 1 | 0 | 0 | 0 | 0 | 0 |
| 2 | 0 | 0 | 0 | 0 | 0 |
| 3 | 0 | 0 | 0 | 0 | 0 |
| 4 | 0 | 0 | 0 | 0 | 0 |
| 5 | 0 | 0 | 0 | 0 | 0 |
| 6 | 0 | 0 | 0 | 0 | 0 |
| 7 | 0 | 1 | 0 | 1 | 0 |
| 8 | 0 | 0 | 0 | 0 | 1 |
| 9 | 1 | 1 | 1 | 1 | 1 |
| 10 | 1 | 1 | 1 | 1 | 1 |
| 11 | 1 | 1 | 1 | 1 | 1 |
| 12 | 1 | 1 | 1 | 1 | 1 |
| 13 | 0 | 0 | 0 | 0 | 0 |
| 14 | 0 | 0 | 0 | 0 | 0 |
| 15 | 0 | 0 | 0 | 0 | 0 |
| 16 | 0 | 0 | 0 | 0 | 0 |
| 17 | 1 | 1 | 0 | 0 | 0 |
| 18 | 0 | 0 | 0 | 0 | 0 |
| 19 | 1 | 1 | 0 | 0 | 0 |
| 20 | 1 | 1 | 0 | 0 | 0 |
| 21 | 1 | 1 | 0 | 0 | 0 |
| 22 | 1 | 1 | 1 | 1 | 1 |
| 23 | 1 | 1 | 1 | 1 | 1 |
| 24 | 1 | 1 | 1 | 1 | 1 |
| 25 | 0 | 0 | 0 | 0 | 0 |
| 26 | 0 | 0 | 0 | 0 | 0 |
| 27 | 0 | 0 | 0 | 0 | 0 |
| 28 | 1 | 1 | 1 | 1 | 1 |
| 29 | 1 | 1 | 1 | 1 | 1 |
| 30 | 1 | 1 | 1 | 1 | 1 |
| 31 | 0 | 0 | 0 | 0 | 0 |
| 32 | 0 | 0 | 0 | 0 | 0 |
| 33 | 1 | 1 | 0 | 0 | 0 |
| 34 | 0 | 0 | 0 | 0 | 0 |
| 35 | 0 | 0 | 0 | 0 | 0 |
| 36 | 0 | 0 | 0 | 0 | 0 |
| 37 | 0 | 0 | 1 | 1 | 1 |
| 38 | 0 | 0 | 0 | 0 | 0 |

TABLE 14-continued

| Transition number | Sam74 | Sam75 | Sam76 | Sam77 | Sam78 |
|---|---|---|---|---|---|
| 39 | 0 | 0 | 0 | 0 | 0 |
| 40 | 1 | 1 | 1 | 1 | 1 |
| 41 | 1 | 1 | 1 | 1 | 1 |
| 42 | 1 | 1 | 1 | 1 | 1 |
| 43 | 0 | 0 | 0 | 0 | 0 |
| 44 | 0 | 0 | 0 | 0 | 0 |
| 45 | 0 | 0 | 0 | 0 | 0 |
| 46 | 0 | 0 | 0 | 0 | 0 |
| 47 | 0 | 0 | 0 | 0 | 0 |
| 48 | 0 | 0 | 0 | 0 | 0 |
| 49 | 0 | 0 | 0 | 0 | 0 |
| 50 | 0 | 0 | 0 | 0 | 0 |
| 51 | 0 | 0 | 0 | 0 | 0 |
| 52 | 0 | 0 | 0 | 0 | 0 |
| 53 | 0 | 0 | 0 | 0 | 0 |
| 54 | 0 | 0 | 0 | 0 | 0 |
| 55 | 1 | 1 | 0 | 1 | 1 |
| 56 | 1 | 1 | 0 | 0 | 0 |
| 57 | 1 | 1 | 0 | 0 | 0 |
| 58 | 0 | 0 | 0 | 0 | 0 |
| 59 | 0 | 0 | 0 | 0 | 0 |
| 60 | 0 | 0 | 0 | 0 | 0 |
| 61 | 0 | 0 | 0 | 0 | 0 |
| 62 | 0 | 0 | 0 | 0 | 0 |
| 63 | 0 | 0 | 0 | 0 | 0 |
| 64 | 0 | 0 | 0 | 0 | 0 |
| 65 | 0 | 0 | 0 | 0 | 0 |
| 66 | 0 | 0 | 0 | 0 | 0 |
| 67 | 1 | 1 | 1 | 1 | 1 |
| 68 | 1 | 1 | 1 | 1 | 1 |
| 69 | 1 | 1 | 1 | 1 | 0 |
| 70 | 0 | 0 | 0 | 0 | 0 |
| 71 | 0 | 0 | 0 | 0 | 0 |
| 72 | 0 | 0 | 0 | 0 | 0 |
| 73 | 1 | 1 | 1 | 1 | 1 |
| 74 | 1 | 1 | 1 | 1 | 1 |
| 75 | 1 | 1 | 1 | 1 | 1 |
| 76 | 1 | 1 | 1 | 1 | 1 |
| 77 | 1 | 1 | 1 | 1 | 1 |
| 78 | 1 | 1 | 1 | 1 | 1 |
| 79 | 0 | 0 | 0 | 0 | 0 |
| 80 | 0 | 0 | 0 | 0 | 0 |
| 81 | 0 | 0 | 0 | 0 | 0 |

Samples Sam74 to Sam78 comprise at least one peptide which is characteristic of PERs. The bacteria present in samples Sam74 to Sam78 therefore express a beta-lactamase which confers on them a resistance to penicillins, cephalosporins and monobactams.

EXAMPLE 13

Identification of a Resistance to VEB Beta-Lactams

Samples Sam79 to Sam82 are identified according to one of the methods described in examples 1, 3 or 4. The identification of the species is set out in TABLE 15.

TABLE 15

| Names | Species |
|---|---|
| Sam79 | *A. baumannii* |
| Sam80 | *A. baumannii* |
| Sam81 | *A. baumannii* |
| Sam82 | *E. coli* |

Samples Sam79 to Sam82 correspond to a species able to comprise a VEB resistance mechanism. Each sample is treated according to example 5, then analysed according to example 6 by detecting the peptides from TABLE 16 instead of the peptides from TABLE 3.

TABLE 16

| Transition number | Peptide | Retention time (minutes) | (m/z) filtered in Q1 | (m/z) filtered in Q3 | Collision energy (eV) | Positivity threshold |
|---|---|---|---|---|---|---|
| 1 | ANEEQMHK | 1.44 | 493.72 | 458.20 | 23.9 | 2000 |
| 2 | ANEEQMHK | 1.44 | 493.72 | 672.31 | 23.9 | 2000 |
| 3 | ANEEQMHK | 1.44 | 493.72 | 801.36 | 23.9 | 2000 |
| 4 | DWNTQYQNWATPTAMNK | 19.05 | 1034.96 | 661.33 | 54.7 | 2000 |
| 5 | DWNTQYQNWATPTAMNK | 19 | 690.31 | 661.33 | 28.5 | 2000 |
| 6 | DWNTQYQNWATPTAMNK | 19.02 | 690.31 | 762.38 | 28.5 | 2000 |
| 7 | ETSEINEK | 6.84 | 475.23 | 390.20 | 22.8 | 2000 |
| 8 | ETSEINEK | 6.84 | 475.23 | 503.28 | 22.8 | 2000 |
| 9 | ETSEINEK | 6.83 | 475.23 | 719.36 | 22.8 | 2000 |
| 10 | ETTTGSNR | 1.38 | 433.20 | 433.22 | 20.4 | 1500 |
| 11 | ETTTGSNR | 1.38 | 433.20 | 534.26 | 20.4 | 1500 |
| 12 | ETTTGSNR | 1.38 | 433.20 | 635.31 | 20.4 | 1500 |
| 13 | FLNANHFTDISIK | 18.72 | 507.27 | 573.30 | 22.8 | 2000 |
| 14 | FLNANHFTDISIK | 18.72 | 507.27 | 630.32 | 22.8 | 2000 |
| 15 | FLNANHFTDISIK | 18.74 | 507.27 | 686.87 | 22.8 | 2000 |
| 16 | FPIALAVLSEIDK | 27.01 | 708.41 | 634.88 | 36.1 | 2000 |
| 17 | FPIALAVLSEIDK | 27.04 | 708.41 | 704.38 | 36.1 | 2000 |
| 18 | FPIALAVLSEIDK | 27.01 | 708.41 | 874.49 | 36.1 | 2000 |
| 19 | GNLSFEQK | 12.65 | 461.74 | 551.28 | 22.1 | 2000 |
| 20 | GNLSFEQK | 12.65 | 461.74 | 638.31 | 22.1 | 2000 |
| 21 | GNLSFEQK | 12.65 | 461.74 | 751.40 | 22.1 | 2000 |
| 22 | GQLPK | 7.19 | 271.67 | 243.16 | 11.2 | 2000 |
| 23 | GQLPK | 7.19 | 271.67 | 357.25 | 11.2 | 2000 |
| 24 | GQLPK | 7.19 | 271.67 | 485.31 | 11.2 | 2000 |
| 25 | IEITPQDLLPK | 21.67 | 633.87 | 405.74 | 31.9 | 2000 |
| 26 | IEITPQDLLPK | 21.67 | 633.87 | 810.47 | 31.9 | 2000 |
| 27 | IEITPQDLLPK | 21.63 | 633.87 | 911.52 | 31.9 | 2000 |
| 28 | IENVLK | 12.89 | 358.22 | 359.27 | 16.2 | 2000 |
| 29 | IENVLK | 12.91 | 358.22 | 473.31 | 16.2 | 2000 |
| 30 | IENVLK | 12.89 | 358.22 | 602.35 | 16.2 | 2000 |
| 31 | IGVAIFNSNEK | 18.09 | 596.32 | 738.34 | 29.7 | 2000 |
| 32 | IGVAIFNSNEK | 18.09 | 596.32 | 851.43 | 29.7 | 2000 |
| 33 | IGVAIFNSNEK | 18.09 | 596.32 | 922.46 | 29.7 | 2000 |
| 34 | IISDIAK | 12.6 | 380.23 | 331.23 | 17.4 | 2000 |
| 35 | IISDIAK | 12.58 | 380.23 | 533.29 | 17.4 | 2000 |
| 36 | IISDIAK | 12.56 | 380.23 | 646.38 | 17.4 | 2000 |
| 37 | INNDFHFPMQSVMK | 20.04 | 569.94 | 740.84 | 24.8 | 2000 |
| 38 | INNDFHFPMQSVMK | 20.04 | 569.94 | 797.86 | 24.8 | 2000 |

TABLE 16-continued

| Transition number | Peptide | Retention time (minutes) | (m/z) filtered Q1 | (m/z) in filtered in Q3 | Collision energy (eV) | Positivity threshold |
|---|---|---|---|---|---|---|
| 39 | INNDFHFPMQSVMK | 20.05 | 569.94 | 820.41 | 24.8 | 2000 |
| 40 | LIGGTDSVQK | 11.48 | 509.28 | 734.37 | 24.8 | 2000 |
| 41 | LIGGTDSVQK | 11.46 | 509.28 | 791.39 | 24.8 | 2000 |
| 42 | LIGGTDSVQK | 11.46 | 509.28 | 904.47 | 24.8 | 2000 |
| 43 | LLIDTYNNK | 15.7 | 547.30 | 639.31 | 26.9 | 2000 |
| 44 | LLIDTYNNK | 15.7 | 547.30 | 754.34 | 26.9 | 2000 |
| 45 | LLIDTYNNK | 15.7 | 547.30 | 867.42 | 26.9 | 2000 |
| 46 | MWSPIK | 16.91 | 381.20 | 357.25 | 17.5 | 2000 |
| 47 | MWSPIK | 16.91 | 381.20 | 444.28 | 17.5 | 2000 |
| 48 | MWSPIK | 16.87 | 381.20 | 630.36 | 17.5 | 2000 |
| 49 | NQLLSK | 10.59 | 351.71 | 347.23 | 15.8 | 2000 |
| 50 | NQLLSK | 10.59 | 351.71 | 460.31 | 15.8 | 2000 |
| 51 | NQLLSK | 10.59 | 351.71 | 588.37 | 15.8 | 2000 |
| 52 | NTIVAHK | 23.75 | 391.73 | 454.28 | 18.1 | 2000 |
| 53 | NTIVAHK | 23.73 | 391.73 | 567.36 | 18.1 | 2000 |
| 54 | NTIVAHK | 23.75 | 391.73 | 668.41 | 18.1 | 2000 |
| 55 | SYDFIWK | 19.92 | 479.74 | 446.28 | 23.1 | 2000 |
| 56 | SYDFIWK | 19.9 | 479.74 | 593.35 | 23.1 | 2000 |
| 57 | SYDFIWK | 19.9 | 479.74 | 708.37 | 23.1 | 2000 |
| 58 | TWSPIK | 14.95 | 366.21 | 357.25 | 16.6 | 2000 |
| 59 | TWSPIK | 14.93 | 366.21 | 444.28 | 16.6 | 2000 |
| 60 | TWSPIK | 14.95 | 366.21 | 630.36 | 16.6 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 40.00 psi |
| Heating gas: | 40.00 psi |
| Collision gas which induces dissociation: | 9.00 psi |
| Dynamic filling: | activated |
| Declustering potential (DP): | 100.00 V |
| Entry potential before Q0 (EP): | 10.00 V |
| Collision cell exit potential (CXP): | 15 V |
| Total cycle time: | 1.2 sec |
| Detection window: | 240 sec |

The areas obtained for each of the transitions and for each of the microorganisms studied were measured. When the areas of the transitions are greater than or equal to the positivity threshold described in TABLE 16, the detection of the transition is considered to be positive and is labelled "1" in TABLE 17. When a transition has an area less than the positivity threshold described in TABLE 16, the transition is considered non-detected and is labelled "0" in TABLE 17.

For a given peptide, when at least 3 transitions are labelled "1", the peptide is considered as being detected.

TABLE 17

| Transition number | Sam79 | Sam80 | Sam81 | Sam82 |
|---|---|---|---|---|
| 1 | 0 | 0 | 0 | 0 |
| 2 | 0 | 0 | 0 | 0 |
| 3 | 0 | 0 | 0 | 0 |
| 4 | 0 | 0 | 0 | 0 |
| 5 | 0 | 0 | 0 | 0 |
| 6 | 0 | 0 | 0 | 0 |
| 7 | 0 | 0 | 0 | 0 |
| 8 | 0 | 0 | 0 | 0 |
| 9 | 0 | 0 | 0 | 0 |
| 10 | 1 | 1 | 1 | 1 |
| 11 | 1 | 1 | 1 | 1 |
| 12 | 1 | 1 | 1 | 0 |
| 13 | 0 | 1 | 1 | 0 |
| 14 | 0 | 1 | 1 | 0 |
| 15 | 0 | 1 | 1 | 0 |
| 16 | 0 | 0 | 0 | 0 |
| 17 | 0 | 0 | 0 | 0 |

TABLE 17-continued

| Transition number | Sam79 | Sam80 | Sam81 | Sam82 |
|---|---|---|---|---|
| 18 | 0 | 0 | 0 | 0 |
| 19 | 0 | 0 | 0 | 0 |
| 20 | 0 | 0 | 0 | 0 |
| 21 | 0 | 0 | 0 | 0 |
| 22 | 0 | 0 | 0 | 0 |
| 23 | 0 | 0 | 0 | 0 |
| 24 | 0 | 0 | 0 | 0 |
| 25 | 1 | 1 | 1 | 1 |
| 26 | 1 | 1 | 1 | 1 |
| 27 | 1 | 1 | 1 | 1 |
| 28 | 0 | 0 | 0 | 0 |
| 29 | 0 | 0 | 0 | 0 |
| 30 | 0 | 0 | 0 | 0 |
| 31 | 0 | 0 | 0 | 0 |
| 32 | 0 | 0 | 0 | 0 |
| 33 | 0 | 0 | 0 | 0 |
| 34 | 0 | 0 | 0 | 0 |
| 35 | 0 | 0 | 0 | 0 |
| 36 | 0 | 0 | 0 | 0 |
| 37 | 0 | 0 | 0 | 0 |
| 38 | 0 | 0 | 0 | 0 |
| 39 | 0 | 0 | 0 | 0 |
| 40 | 1 | 1 | 1 | 0 |
| 41 | 0 | 1 | 0 | 0 |
| 42 | 1 | 0 | 1 | 0 |
| 43 | 0 | 0 | 0 | 0 |
| 44 | 0 | 0 | 0 | 0 |
| 45 | 0 | 0 | 0 | 0 |
| 46 | 0 | 0 | 0 | 0 |
| 47 | 0 | 0 | 0 | 0 |
| 48 | 0 | 0 | 0 | 0 |
| 49 | 0 | 0 | 0 | 0 |
| 50 | 0 | 0 | 0 | 0 |
| 51 | 0 | 0 | 0 | 0 |
| 52 | 0 | 0 | 0 | 0 |
| 53 | 0 | 0 | 0 | 0 |
| 54 | 0 | 0 | 0 | 0 |
| 55 | 1 | 1 | 1 | 0 |
| 56 | 1 | 1 | 1 | 0 |
| 57 | 1 | 1 | 1 | 0 |
| 58 | 0 | 0 | 0 | 0 |
| 59 | 0 | 0 | 0 | 0 |
| 60 | 0 | 0 | 0 | 0 |

Samples Sam79 to Sam82 comprise at least one peptide which is characteristic of VEBs. The bacteria present in samples Sam79 to Sam82 therefore express a beta-lactamase which confers on them a resistance to penicillins, cephalosporins and monobactams.

EXAMPLE 14

Identification of a Resistance to MOX Beta-Lactams

Sample Sam83 is identified according to one of the methods described in examples 1, 3 or 4. The identification of the species is set out in TABLE 18.

TABLE 18

| Names | Species |
|---|---|
| Sam83 | E. coli |

Sample Sam83 corresponds to a species able to comprise a MOX resistance mechanism. Each sample is treated according to example 5, then analysed according to example 6 by detecting the peptides from TABLE 19 instead of the peptides from TABLE 3.

TABLE 19

| Transition number | Peptide | Retention time (minutes) | (m/z) filtered in Q1 | (m/z) filtered in Q3 | Collision energy (eV) | Positivity threshold |
|---|---|---|---|---|---|---|
| 1 | AHYFNYGVADR | 14.36 | 656.807 | 621.289 | 33.2 | 2000 |
| 2 | AHYFNYGVADR | 14.36 | 656.807 | 941.448 | 33.2 | 2000 |
| 3 | AHYFNYGVADR | 14.34 | 656.807 | 1104.511 | 33.2 | 2000 |
| 4 | ANISGVDDK | 9.88 | 459.73 | 533.257 | 21.9 | 2000 |
| 5 | ANISGVDDK | 9.86 | 459.73 | 620.289 | 21.9 | 2000 |
| 6 | ANISGVDDK | 9.86 | 459.73 | 733.373 | 21.9 | 2000 |
| 7 | ANISGVHDK | 7.75 | 470.746 | 555.289 | 22.6 | 2000 |
| 8 | ANISGVHDK | 7.67 | 470.746 | 642.321 | 22.6 | 2000 |
| 9 | ANISGVHDK | 7.69 | 470.746 | 755.405 | 22.6 | 2000 |
| 10 | ASLFAPWLK | 23.52 | 516.797 | 543.329 | 25.2 | 2000 |
| 11 | ASLFAPWLK | 23.56 | 516.797 | 614.366 | 25.2 | 2000 |
| 12 | ASLFAPWLK | 23.56 | 516.797 | 761.434 | 25.2 | 2000 |
| 13 | EDKPFR | 8.09 | 396.206 | 419.24 | 18.3 | 2000 |
| 14 | EDKPFR | 8.07 | 396.206 | 547.335 | 18.3 | 2000 |
| 15 | EDKPFR | 8.09 | 396.206 | 662.362 | 18.3 | 2000 |
| 16 | ESGNLMLFNK | 18.39 | 576.79 | 408.224 | 28.6 | 2000 |

TABLE 19-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 17 | ESGNLMLFNK | 18.39 | 576.79 | 521.308 | 28.6 | 2000 |
| 18 | ESGNLMLFNK | 18.39 | 576.79 | 652.349 | 28.6 | 2000 |
| 19 | ESGSQMLFNK | 15.08 | 570.771 | 408.224 | 28.3 | 2000 |
| 20 | ESGSQMLFNK | 15.14 | 570.771 | 521.308 | 28.3 | 2000 |
| 21 | ESGSQMLFNK | 15.12 | 570.771 | 652.349 | 28.3 | 2000 |
| 22 | GHPVLFNK | 12.74 | 456.259 | 408.224 | 21.7 | 2000 |
| 23 | GHPVLFNK | 12.78 | 456.259 | 521.308 | 21.7 | 2000 |
| 24 | GHPVLFNK | 12.78 | 456.259 | 717.429 | 21.7 | 2000 |
| 25 | GIGVVMLANR | 18.19 | 515.297 | 604.324 | 25.1 | 2000 |
| 26 | GIGVVMLANR | 18.17 | 515.297 | 703.392 | 25.1 | 2000 |
| 27 | GIGVVMLANR | 18.17 | 515.297 | 859.482 | 25.1 | 2000 |
| 28 | MQAYYR | 11.12 | 416.195 | 501.246 | 19.5 | 2000 |
| 29 | MQAYYR | 11.14 | 416.195 | 572.283 | 19.5 | 2000 |
| 30 | MQAYYR | 11.12 | 416.195 | 700.341 | 19.5 | 2000 |
| 31 | NSPIEAR | 9.4 | 393.709 | 375.199 | 18.2 | 2000 |
| 32 | NSPIEAR | 9.4 | 393.709 | 488.283 | 18.2 | 2000 |
| 33 | NSPIEAR | 9.4 | 393.709 | 585.335 | 18.2 | 2000 |
| 34 | NSPIEGTLK | 13.36 | 479.764 | 379.226 | 23.1 | 2000 |
| 35 | NSPIEGTLK | 13.36 | 479.764 | 547.309 | 23.1 | 2000 |
| 36 | NSPIEGTLK | 13.34 | 479.764 | 757.445 | 23.1 | 2000 |
| 37 | NYPNEGTLK | 11.6 | 518.259 | 379.706 | 25.3 | 2000 |
| 38 | NYPNEGTLK | 11.62 | 518.259 | 661.352 | 25.3 | 2000 |
| 39 | NYPNEGTLK | 11.58 | 518.259 | 758.404 | 25.3 | 2000 |
| 40 | QPFDR | 9.48 | 331.666 | 437.214 | 14.6 | 2000 |
| 41 | QPFDR | 9.5 | 331.666 | 488.214 | 14.6 | 2000 |
| 42 | QPFDR | 9.48 | 331.666 | 534.267 | 14.6 | 2000 |
| 43 | QWTPAYSPGSHR | 13.34 | 693.831 | 486.238 | 35.3 | 2000 |
| 44 | QWTPAYSPGSHR | 13.34 | 693.831 | 640.316 | 35.3 | 2000 |
| 45 | QWTPAYSPGSHR | 13.34 | 693.831 | 971.469 | 35.3 | 2000 |
| 46 | QWTPAYSR | 13.46 | 504.749 | 496.251 | 24.5 | 2000 |
| 47 | QWTPAYSR | 13.48 | 504.749 | 593.304 | 24.5 | 2000 |
| 48 | QWTPAYSR | 13.46 | 504.749 | 694.352 | 24.5 | 2000 |
| 49 | QYANPSIGLFGYLAASSMK | 25.46 | 673.34 | 594.292 | 28 | 2000 |
| 50 | QYANPSIGLFGYLAASSMK | 25.5 | 673.34 | 594.31 | 28 | 2000 |
| 51 | QYANPSIGLFGYLAASSMK | 25.5 | 673.34 | 927.46 | 28 | 2000 |
| 52 | QYSNPSIGLFGHLAASSMK | 21.21 | 670.003 | 609.819 | 27.9 | 2000 |
| 53 | QYSNPSIGLFGHLAASSMK | 21.17 | 670.003 | 758.403 | 27.9 | 2000 |
| 54 | QYSNPSIGLFGHLAASSMK | 21.21 | 670.003 | 858.941 | 27.9 | 2000 |

TABLE 19-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 55 | TGSSNGFGAYVAFVPAR | 20.79 | 850.923 | 343.209 | 100 | 2000 |
| 56 | TGSSNGFGAYVAFVPAR | 20.78 | 850.923 | 380.229 | 100 | 2000 |
| 57 | TGSSNGFGAYVAFVPAR | 20.78 | 850.923 | 442.277 | 100 | 2000 |
| 58 | TGSTNGFGAYVAFVPAK | 20.45 | 843.928 | 315.203 | 100 | 2000 |
| 59 | TGSTNGFGAYVAFVPAK | 20.46 | 843.928 | 366.226 | 100 | 2000 |
| 60 | TGSTNGFGAYVAFVPAK | 20.46 | 843.928 | 414.271 | 100 | 2000 |
| 61 | TGSTSGFGAYVAFVPAK | 20.64 | 553.951 | 632.377 | 24.3 | 2000 |
| 62 | TGSTSGFGAYVAFVPAK | 20.66 | 830.422 | 315.203 | 43.1 | 2000 |
| 63 | TGSTSGFGAYVAFVPAK | 20.66 | 830.422 | 414.271 | 43.1 | 2000 |
| 64 | TLTATLGAYAVVQGSFELDDK | 18.71 | 733.711 | 569.275 | 29.8 | 2000 |
| 65 | TLTATLGAYAVVQGSFELDDK | 18.71 | 733.711 | 654.328 | 29.8 | 2000 |
| 66 | TLTATLGAYAVVQGSFELDDK | 18.71 | 733.711 | 1137.542 | 29.8 | 2000 |
| 67 | VSPGMLADEAYGIK | 18.63 | 725.866 | 632.816 | 37.1 | 2000 |
| 68 | VSPGMLADEAYGIK | 18.63 | 725.866 | 866.425 | 37.1 | 2000 |
| 69 | VSPGMLADEAYGIK | 18.65 | 725.866 | 1167.571 | 37.1 | 2000 |
| 70 | VTPAMLAEEPYGIK | 19.05 | 506.934 | 577.334 | 22.8 | 2000 |
| 71 | VTPAMLAEEPYGIK | 19.05 | 759.897 | 659.839 | 39 | 2000 |
| 72 | VTPAMLAEEPYGIK | 19.07 | 759.897 | 906.457 | 39 | 2000 |
| 73 | YAYPVSEQTLLAGNSAK | 18.09 | 604.644 | 547.283 | 25.8 | 2000 |
| 74 | YAYPVSEQTLLAGNSAK | 18.07 | 604.644 | 660.368 | 25.8 | 2000 |
| 75 | YAYPVSEQTLLAGNSAK | 18.09 | 906.462 | 707.88 | 47.4 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 40.00 psi |
| Cone voltage: | 5500.00 V |
| Source temperature: | 500.00° C. |
| Nebulising gas: | 40.00 psi |
| Heating gas: | 40.00 psi |
| Collision gas which induces dissociation: | 9.00 psi |
| Dynamic filling: | activated |
| Declustering potential (DP): | 100.00 V |
| Entry potential before Q0 (EP): | 10.00 V |
| Collision cell exit potential (CXP): | 15 V |
| Total cycle time: | 1 sec |
| Detection window: | 240 sec |

The areas obtained for each of the transitions and for each of the microorganisms studied were measured. When the areas of the transitions are greater than or equal to the positivity threshold described in TABLE 19, the detection of the transition is considered to be positive and is labelled "1" in TABLE 20. When a transition has an area less than the positivity threshold described in TABLE 19, the transition is considered non-detected and is labelled "0" in TABLE 20.

For a given peptide, when at least 3 transitions are labelled "1", the peptide is considered as being detected.

TABLE 20

| Transition number | Sam83 |
|---|---|
| 1 | 0 |
| 2 | 0 |
| 3 | 0 |
| 4 | 0 |
| 5 | 0 |
| 6 | 0 |
| 7 | 1 |
| 8 | 1 |
| 9 | 1 |
| 10 | 0 |
| 11 | 0 |
| 12 | 0 |
| 13 | 0 |
| 14 | 0 |
| 15 | 0 |
| 16 | 0 |
| 17 | 0 |

TABLE 20-continued

| Transition number | Sam83 |
|---|---|
| 18 | 0 |
| 19 | 0 |
| 20 | 0 |
| 21 | 0 |
| 22 | 0 |
| 23 | 0 |
| 24 | 0 |
| 25 | 0 |
| 26 | 0 |
| 27 | 0 |
| 28 | 0 |
| 29 | 0 |
| 30 | 0 |
| 31 | 0 |
| 32 | 0 |
| 33 | 0 |
| 34 | 0 |
| 35 | 0 |
| 36 | 0 |
| 37 | 0 |
| 38 | 0 |
| 39 | 0 |
| 40 | 0 |
| 41 | 0 |
| 42 | 0 |
| 43 | 1 |
| 44 | 1 |
| 45 | 1 |
| 46 | 0 |
| 47 | 0 |
| 48 | 0 |
| 49 | 0 |
| 50 | 0 |
| 51 | 0 |
| 52 | 0 |
| 53 | 0 |
| 54 | 0 |
| 55 | 0 |
| 56 | 0 |
| 57 | 0 |
| 58 | 0 |
| 59 | 0 |
| 60 | 0 |
| 61 | 0 |
| 62 | 0 |
| 63 | 0 |
| 64 | 0 |
| 65 | 0 |
| 66 | 0 |
| 67 | 1 |
| 68 | 1 |
| 69 | 1 |
| 70 | 0 |
| 71 | 0 |
| 72 | 0 |
| 73 | 0 |
| 74 | 0 |
| 75 | 0 |

Sample Sam83 comprises at least one peptide which is characteristic of MOXs. The bacteria present in sample Sam83 therefore express a beta-lactamase which confers on them a resistance to penicillins and to cephalosporins, with the exception of fourth-generation cephalosporins.

EXAMPLE 15

Identification of a Resistance to ACC Beta-Lactams

The samples corresponding to a species able to comprise an ACC resistance mechanism can be detected by employing the following method.

Each sample is treated according to example 5, then analysed according to example 6 by detecting the peptides from TABLE 21 instead of the peptides from TABLE 3.

TABLE 21

| Transition number | Peptide | Retention time (minutes) | (m/z) filtered in Q1 | (m/z) filtered in Q3 | Collision energy (eV) |
|---|---|---|---|---|---|
| 1 | ALTDTHIGYFK | 15.83 | 422.56 | 457.24 | 25 |
| 2 | ALTDTHIGYFK | 15.83 | 422.56 | 514.27 | 25 |
| 3 | ALTDTHIGYFK | 15.83 | 422.56 | 627.35 | 25 |
| 4 | AWKPADPAGTHR | 10.49 | 436.23 | 470.25 | 26 |
| 5 | AWKPADPAGTHR | 10.49 | 436.23 | 638.34 | 26 |
| 6 | AWKPADPAGTHR | 10.49 | 436.23 | 669.34 | 26 |
| 7 | DEPVHGNMEILGNEAYGIK | 18.07 | 696 | 851.43 | 39 |
| 8 | DEPVHGNMEILGNEAYGIK | 18.07 | 696 | 1009.4 | 39 |
| 9 | DEPVHGNMEILGNEAYGIK | 18.07 | 696 | 1122.49 | 39 |
| 10 | DTVDGLIQPLMQK | 20.72 | 729.39 | 857.49 | 37 |
| 11 | DTVDGLIQPLMQK | 20.72 | 729.39 | 970.58 | 37 |
| 12 | DTVDGLIQPLMQK | 20.72 | 729.39 | 1027.6 | 37 |
| 13 | DTVDSLIQPLMQK | 21.62 | 744.39 | 857.49 | 38 |
| 14 | DTVDSLIQPLMQK | 21.62 | 744.39 | 1057.61 | 38 |
| 15 | DTVDSLIQPLMQK | 21.62 | 744.39 | 1172.63 | 38 |

TABLE 21-continued

| Transition number | Peptide | Retention time (minutes) | (m/z) filtered in Q1 | (m/z) filtered in Q3 | Collision energy (eV) |
|---|---|---|---|---|---|
| 16 | IQHALTATHTGYFK | 12.76 | 397.71 | 514.27 | 23 |
| 17 | IQHALTATHTGYFK | 12.76 | 397.71 | 615.31 | 23 |
| 18 | IQHALTATHTGYFK | 12.76 | 397.71 | 752.37 | 23 |
| 19 | LDGNSTLQK | 9.44 | 488.26 | 576.34 | 26 |
| 20 | LDGNSTLQK | 9.44 | 488.26 | 747.4 | 26 |
| 21 | LDGNSTLQK | 9.44 | 488.26 | 862.43 | 26 |
| 22 | LSLDK | 10.73 | 288.17 | 375.22 | 18 |
| 23 | LSLDK | 10.73 | 288.17 | 429.23 | 18 |
| 24 | LSLDK | 10.73 | 288.17 | 462.26 | 18 |
| 25 | LSLEQSVSHYVPELR | 20.3 | 586.31 | 776.43 | 33 |
| 26 | LSLEQSVSHYVPELR | 20.3 | 586.31 | 913.49 | 33 |
| 27 | LSLEQSVSHYVPELR | 20.3 | 586.31 | 1000.52 | 33 |
| 28 | NEPIHVNMEVLGNEAYGIR | 19.55 | 719.02 | 879.43 | 40 |
| 29 | NEPIHVNMEVLGNEAYGIR | 19.55 | 719.02 | 992.52 | 40 |
| 30 | NEPIHVNMEVLGNEAYGIR | 19.55 | 719.02 | 1163.55 | 40 |
| 31 | NNIPGMSVAVTIR | 18.3 | 457.92 | 559.36 | 27 |
| 32 | NNIPGMSVAVTIR | 18.3 | 686.37 | 933.52 | 35 |
| 33 | NNIPGMSVAVTIR | 18.3 | 686.37 | 1030.57 | 35 |
| 34 | NTDQLMAYLK | 18.78 | 598.8 | 625.34 | 31 |
| 35 | NTDQLMAYLK | 18.78 | 598.8 | 738.42 | 31 |
| 36 | NTDQLMAYLK | 18.78 | 598.8 | 981.51 | 31 |
| 37 | NTTQLMTYLK | 17.75 | 606.82 | 768.43 | 32 |
| 38 | NTTQLMTYLK | 17.75 | 606.82 | 896.49 | 32 |
| 39 | NTTQLMTYLK | 17.75 | 606.82 | 997.54 | 32 |
| 40 | NYIYNYGLASK | 15.9 | 653.33 | 752.39 | 34 |
| 41 | NYIYNYGLASK | 15.9 | 653.33 | 915.46 | 34 |
| 42 | NYIYNYGLASK | 15.9 | 653.33 | 1028.54 | 34 |
| 43 | SISHYVPELR | 15 | 400.88 | 514.3 | 24 |
| 44 | SISHYVPELR | 15 | 400.88 | 613.37 | 24 |
| 45 | SISHYVPELR | 15 | 400.88 | 776.43 | 24 |
| 46 | TFAAILASYAQASGK | 21.64 | 749.9 | 811.39 | 38 |
| 47 | TFAAILASYAQASGK | 21.64 | 749.9 | 882.43 | 38 |
| 48 | TFAAILASYAQASGK | 21.64 | 749.9 | 995.52 | 38 |
| 49 | TLLPK | 12.05 | 286.19 | 357.25 | 18 |
| 50 | TLLPK | 12.05 | 286.19 | 425.28 | 18 |
| 51 | TLLPK | 12.05 | 286.19 | 470.33 | 18 |
| 52 | TNASDLIR | 12.95 | 445.24 | 516.31 | 25 |
| 53 | TNASDLIR | 12.95 | 445.24 | 603.35 | 25 |

TABLE 21-continued

| Transition number | Peptide | Retention time (minutes) | (m/z) filtered in Q1 | (m/z) filtered in Q3 | Collision energy (eV) |
|---|---|---|---|---|---|
| 54 | TNASDLIR | 12.95 | 445.24 | 674.38 | 25 |
| 55 | VTVAYK | 10.34 | 340.7 | 381.21 | 20 |
| 56 | VTVAYK | 10.34 | 340.7 | 480.28 | 20 |
| 57 | VTVAYK | 10.34 | 340.7 | 581.33 | 20 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 16

Identification of a Resistance to ACT Beta-Lactams

The samples corresponding to a species able to comprise an ACT resistance mechanism can be detected by employing the following method.

Each sample is treated according to example 5, then analysed according to example 6 by detecting the peptides from TABLE 22 instead of the peptides from TABLE 3.

TABLE 22

| Transition number | Peptide | Retention time (minutes) | (m/z) filtered in Q1 | (m/z) filtered in Q3 | Collision energy (eV) |
|---|---|---|---|---|---|
| 1 | AEEAHYAWGYR | 14.21 | 676.81 | 815.38 | 34.8 |
| 2 | AEEAHYAWGYR | 14.21 | 676.81 | 952.44 | 34.8 |
| 3 | AEEAHYAWGYR | 14.21 | 676.81 | 1152.52 | 34.8 |
| 4 | AIHVSPGMLDAEAYGVK | 18.71 | 586.64 | 666.35 | 33.3 |
| 5 | AIHVSPGMLDAEAYGVK | 18.71 | 586.64 | 737.38 | 33.3 |
| 6 | AIHVSPGMLDAEAYGVK | 18.74 | 586.64 | 852.41 | 33.3 |
| 7 | AVHVSPGMLDAEAYGVK | 17.93 | 581.96 | 666.35 | 33.1 |
| 8 | AVHVSPGMLDAEAYGVK | 17.93 | 581.96 | 737.38 | 33.1 |
| 9 | AVHVSPGMLDAEAYGVK | 17.93 | 581.96 | 852.41 | 33.1 |
| 10 | DMANWVMVNMKPDSLQDSSLK | 22.23 | 803.71 | 896.45 | 44.2 |
| 11 | DMANWVMVNMKPDSLQDSSLK | 22.21 | 803.71 | 989.49 | 44.2 |
| 12 | DMANWVMVNMKPDSLQDSSLK | 22.23 | 803.71 | 1082.03 | 44.2 |
| 13 | DNASLLR | 12.76 | 394.72 | 401.29 | 22.4 |
| 14 | DNASLLR | 12.76 | 394.72 | 488.32 | 22.4 |
| 15 | DNASLLR | 12.76 | 394.72 | 559.36 | 22.4 |
| 16 | EGITLAQSR | 13.23 | 487.77 | 574.33 | 26.5 |
| 17 | EGITLAQSR | 13.25 | 487.77 | 675.38 | 26.5 |
| 18 | EGITLAQSR | 13.23 | 487.77 | 788.46 | 26.5 |
| 19 | EVNPPAPPVNASWVHK | 16.59 | 581.31 | 700.38 | 33.1 |
| 20 | EVNPPAPPVNASWVHK | 16.61 | 581.31 | 757.4 | 33.1 |
| 21 | EVNPPAPPVNASWVHK | 16.61 | 581.31 | 1134.61 | 33.1 |
| 22 | FYQNWQPQWKPGTTR | 17.43 | 968.98 | 531.29 | 47.6 |
| 23 | FYQNWQPQWKPGTTR | 17.43 | 968.98 | 1070.57 | 47.6 |

TABLE 22-continued

| Transition number | Peptide | Retention time (minutes) | (m/z) filtered in Q1 | (m/z) filtered in Q3 | Collision energy (eV) |
|---|---|---|---|---|---|
| 24 | FYQNWQPQWKPGTTR | 17.43 | 968.98 | 1198.63 | 47.6 |
| 25 | GEISLDDPVTR | 16.1 | 601.31 | 702.34 | 31.5 |
| 26 | GEISLDDPVTR | 16.1 | 601.31 | 815.43 | 31.5 |
| 27 | GEISLDDPVTR | 16.12 | 601.31 | 902.46 | 31.5 |
| 28 | GEISLGDPVTK | 15.7 | 558.3 | 559.31 | 29.6 |
| 29 | GEISLGDPVTK | 15.68 | 558.3 | 616.33 | 29.6 |
| 30 | GEISLGDPVTK | 15.68 | 558.3 | 816.45 | 29.6 |
| 31 | GLTLAQSR | 12.67 | 423.25 | 461.25 | 23.6 |
| 32 | GLTLAQSR | 12.68 | 423.25 | 574.33 | 23.6 |
| 33 | GLTLAQSR | 12.65 | 423.25 | 675.38 | 23.6 |
| 34 | LDHTWINVPK | 16.79 | 611.83 | 497.78 | 31.9 |
| 35 | LDHTWINVPK | 16.79 | 611.83 | 756.44 | 31.9 |
| 36 | LDHTWINVPK | 16.79 | 611.83 | 857.49 | 31.9 |
| 37 | MLDLATYTAGGLPLQVPDEVK | 23.87 | 744.39 | 512.79 | 41.2 |
| 38 | MLDLATYTAGGLPLQVPDEVK | 23.89 | 744.39 | 587.3 | 41.2 |
| 39 | MLDLATYTAGGLPLQVPDEVK | 23.89 | 1116.09 | 587.3 | 54.1 |
| 40 | QGIALAQSR | 12.72 | 472.27 | 574.33 | 25.8 |
| 41 | QGIALAQSR | 12.7 | 472.27 | 645.37 | 25.8 |
| 42 | QGIALAQSR | 12.72 | 472.27 | 758.45 | 25.8 |
| 43 | QGISLAQSR | 12.83 | 480.27 | 661.36 | 26.1 |
| 44 | QGISLAQSR | 12.83 | 480.27 | 774.45 | 26.1 |
| 45 | QGISLAQSR | 12.83 | 480.27 | 831.47 | 26.1 |
| 46 | QIGIVMLANK | 18.95 | 543.82 | 576.32 | 28.9 |
| 47 | QIGIVMLANK | 18.95 | 543.82 | 675.39 | 28.9 |
| 48 | QIGIVMLANK | 18.95 | 543.82 | 845.49 | 28.9 |
| 49 | QIGIVMLANTSYPNPAR | 21.86 | 615.66 | 554.31 | 34.8 |
| 50 | QIGIVMLANTSYPNPAR | 21.86 | 615.66 | 717.37 | 34.8 |
| 51 | QIGIVMLANTSYPNPAR | 21.86 | 922.99 | 554.31 | 45.6 |
| 52 | QLAEVVANTVTPLMK | 21.94 | 807.45 | 488.29 | 40.5 |
| 53 | QLAEVVANTVTPLMK | 21.94 | 807.45 | 974.53 | 40.5 |
| 54 | QLAEVVANTVTPLMK | 21.94 | 807.45 | 1073.6 | 40.5 |
| 55 | QLAEVVER | 13.05 | 472.26 | 502.3 | 25.8 |
| 56 | QLAEVVER | 13.03 | 472.26 | 631.34 | 25.8 |
| 57 | QLAEVVER | 13.03 | 472.26 | 702.38 | 25.8 |
| 58 | QLGIVMLANK | 19.27 | 543.82 | 576.32 | 28.9 |
| 59 | QLGIVMLANK | 19.27 | 543.82 | 675.39 | 28.9 |
| 60 | QLGIVMLANK | 19.27 | 543.82 | 845.49 | 28.9 |
| 61 | SYPNPAR | 9.83 | 402.7 | 343.21 | 22.7 |

TABLE 22-continued

| Transition number | Peptide | Retention time (minutes) | (m/z) filtered in Q1 | (m/z) filtered in Q3 | Collision energy (eV) |
|---|---|---|---|---|---|
| 62 | SYPNPAR | 9.83 | 402.7 | 457.25 | 22.7 |
| 63 | SYPNPAR | 9.83 | 402.7 | 554.31 | 22.7 |
| 64 | TFTGVLGGDAIAR | 18.42 | 639.35 | 659.35 | 33.1 |
| 65 | TFTGVLGGDAIAR | 18.39 | 639.35 | 772.43 | 33.1 |
| 66 | TFTGVLGGDAIAR | 18.42 | 639.35 | 1029.57 | 33.1 |
| 67 | TGSTGGFGSYVAFIPEK | 21.14 | 573.29 | 373.21 | 32.7 |
| 68 | TGSTGGFGSYVAFIPEK | 21.14 | 573.29 | 633.36 | 32.7 |
| 69 | TGSTGGFGSYVAFIPEK | 21.14 | 573.29 | 704.4 | 32.7 |
| 70 | TVTPLMK | 13.65 | 395.23 | 488.29 | 22.4 |
| 71 | TVTPLMK | 13.65 | 395.23 | 589.34 | 22.4 |
| 72 | TVTPLMK | 13.62 | 395.23 | 688.41 | 22.4 |
| 73 | TVVEGSDNK | 4.64 | 474.74 | 520.24 | 25.9 |
| 74 | TVVEGSDNK | 4.64 | 474.74 | 649.28 | 25.9 |
| 75 | TVVEGSDNK | 4.64 | 474.74 | 748.35 | 25.9 |
| 76 | VALAPLPAR | 15.96 | 454.29 | 553.35 | 25 |
| 77 | VALAPLPAR | 15.99 | 454.29 | 624.38 | 25 |
| 78 | VALAPLPAR | 15.96 | 454.29 | 737.47 | 25 |
| 79 | VALAPLPVAEVNPPAPPVK | 21.12 | 627.04 | 705.43 | 35.4 |
| 80 | VALAPLPVAEVNPPAPPVK | 21.14 | 627.04 | 762.94 | 35.4 |
| 81 | VALAPLPVAEVNPPAPPVK | 21.14 | 627.04 | 819.47 | 35.4 |
| 82 | VEAAYR | 8.39 | 354.69 | 409.22 | 20.6 |
| 83 | VEAAYR | 8.39 | 354.69 | 480.26 | 20.6 |
| 84 | VEAAYR | 8.39 | 354.69 | 609.3 | 20.6 |
| 85 | VFKPLK | 11.66 | 366.24 | 357.25 | 21.1 |
| 86 | VFKPLK | 11.66 | 366.24 | 485.35 | 21.1 |
| 87 | VFKPLK | 11.66 | 366.24 | 632.41 | 21.1 |
| 88 | VGAMYQGLGWEMLNWPVDAK | 26.23 | 755.7 | 529.3 | 41.8 |
| 89 | VGAMYQGLGWEMLNWPVDAK | 26.23 | 755.7 | 829.42 | 41.8 |
| 90 | VGAMYQGLGWEMLNWPVDAK | 26.26 | 755.7 | 1073.55 | 41.8 |
| 91 | VLKPLK | 10.38 | 349.25 | 357.25 | 20.4 |
| 92 | VLKPLK | 10.36 | 349.25 | 485.35 | 20.4 |
| 93 | VLKPLK | 10.36 | 349.25 | 598.43 | 20.4 |
| 94 | VSPGMLDAQAYGMK | 17.62 | 734.35 | 641.3 | 37.3 |
| 95 | VSPGMLDAQAYGMK | 17.62 | 734.35 | 883.4 | 37.3 |
| 96 | VSPGMLDAQAYGMK | 17.62 | 734.35 | 996.48 | 37.3 |
| 97 | VSPGMLDAQAYGVK | 17.36 | 718.37 | 625.32 | 36.6 |
| 98 | VSPGMLDAQAYGVK | 17.36 | 718.37 | 851.43 | 36.6 |
| 99 | VSPGMLDAQAYGVK | 17.36 | 718.37 | 964.51 | 36.6 |

TABLE 22-continued

| Transition number | Peptide | Retention time (minutes) | (m/z) filtered in Q1 | (m/z) filtered in Q3 | Collision energy (eV) |
|---|---|---|---|---|---|
| 100 | YWPQLTGK | 17.33 | 496.76 | 322.19 | 26.9 |
| 101 | YWPQLTGK | 17.33 | 496.76 | 643.38 | 26.9 |
| 102 | YWPQLTGK | 17.31 | 496.76 | 829.46 | 26.9 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 17

Identification of a Resistance to CMY Beta-Lactams

The samples corresponding to a species able to comprise a CMY resistance mechanism can be detected by employing the following method.

Each sample is treated according to example 5, then analysed according to example 6 by detecting the peptides from TABLE 23 instead of the peptides from TABLE 3.

TABLE 23

| Transition number | Peptide | Retention time (minutes) | (m/z) filtered in Q1 | (m/z) filtered in Q3 | Collision energy (eV) |
|---|---|---|---|---|---|
| 1 | AALLR | 10.85 | 272.18 | 288.2 | 17 |
| 2 | AALLR | 10.85 | 272.18 | 401.29 | 17 |
| 3 | AALLR | 10.85 | 272.18 | 472.32 | 17 |
| 4 | ADSIINGSDNK | 10.62 | 567.28 | 747.36 | 30 |
| 5 | ADSIINGSDNK | 10.62 | 567.28 | 860.45 | 30 |
| 6 | ADSIINGSDNK | 10.62 | 567.28 | 947.48 | 30 |
| 7 | AELLR | 11.13 | 301.19 | 401.29 | 18 |
| 8 | AELLR | 11.13 | 301.19 | 427.26 | 18 |
| 9 | AELLR | 11.13 | 301.19 | 530.33 | 18 |
| 10 | ALQQAISLTHK | 13.79 | 605.35 | 698.42 | 32 |
| 11 | ALQQAISLTHK | 13.79 | 605.35 | 769.46 | 32 |
| 12 | ALQQAISLTHK | 13.79 | 605.35 | 897.52 | 32 |
| 13 | AVHVSPGQLDAEAYGVK | 15.59 | 580.97 | 737.38 | 33 |
| 14 | AVHVSPGQLDAEAYGVK | 15.59 | 580.97 | 776.4 | 33 |
| 15 | AVHVSPGQLDAEAYGVK | 15.59 | 580.97 | 852.41 | 33 |
| 16 | DYAC[CAM]GYR | 9.86 | 452.68 | 555.23 | 25 |
| 17 | DYAC[CAM]GYR | 9.86 | 452.68 | 626.27 | 25 |
| 18 | DYAC[CAM]GYR | 9.86 | 452.68 | 789.33 | 25 |
| 19 | DYALGYR | 13.44 | 429.21 | 508.29 | 24 |
| 20 | DYALGYR | 13.44 | 429.21 | 579.32 | 24 |
| 21 | DYALGYR | 13.44 | 429.21 | 742.39 | 24 |
| 22 | EGKPVHASPGQLDAEAYGVK | 13.47 | 685.02 | 737.38 | 38 |
| 23 | EGKPVHASPGQLDAEAYGVK | 13.47 | 685.02 | 852.41 | 38 |
| 24 | EGKPVHASPGQLDAEAYGVK | 13.47 | 685.02 | 965.49 | 38 |

TABLE 23-continued

| Transition number | Peptide | Retention time (minutes) | (m/z) filtered in Q1 | (m/z) filtered in Q3 | Collision energy (eV) |
|---|---|---|---|---|---|
| 25 | EGKPVHGSPGQLDAEAYGVK | 13.08 | 510.51 | 537.3 | 29 |
| 26 | EGKPVHGSPGQLDAEAYGVK | 13.08 | 510.51 | 666.35 | 29 |
| 27 | EGKPVHGSPGQLDAEAYGVK | 13.08 | 510.51 | 737.38 | 29 |
| 28 | EGKPVHVSPEQLDAEAYGVK | 15.07 | 539.03 | 737.38 | 30 |
| 29 | EGKPVHVSPEQLDAEAYGVK | 15.07 | 539.03 | 852.41 | 30 |
| 30 | EGKPVHVSPEQLDAEAYGVK | 15.07 | 718.37 | 852.41 | 40 |
| 31 | EGKPVHVSPGQFDAEAYGVK | 15.01 | 529.52 | 537.3 | 29 |
| 32 | EGKPVHVSPGQFDAEAYGVK | 15.01 | 529.52 | 632.33 | 29 |
| 33 | EGKPVHVSPGQFDAEAYGVK | 15.01 | 705.69 | 999.48 | 39 |
| 34 | EGKPVHVSPGQLDAEAYC[CAM]VK | 14.63 | 546.77 | 569.28 | 30 |
| 35 | EGKPVHVSPGQLDAEAYC[CAM]VK | 14.63 | 546.77 | 640.31 | 30 |
| 36 | EGKPVHVSPGQLDAEAYC[CAM]VK | 14.63 | 546.77 | 769.35 | 30 |
| 37 | EGKPVHVSPGQLDAEAYGVK | 14.65 | 521.02 | 537.3 | 29 |
| 38 | EGKPVHVSPGQLDAEAYGVK | 14.65 | 521.02 | 737.38 | 29 |
| 39 | EGKPVHVSPGQLDAEAYGVK | 14.65 | 521.02 | 852.41 | 29 |
| 40 | EGKPVHVSPGQLDAGAYGVK | 14.19 | 503.02 | 594.32 | 28 |
| 41 | EGKPVHVSPGQLDAGAYGVK | 14.19 | 503.02 | 665.36 | 28 |
| 42 | EGKPVHVSPGQLDAGAYGVK | 14.19 | 503.02 | 780.39 | 28 |
| 43 | EGKPVHVSPGQLNAEAYGVK | 14.25 | 520.78 | 537.3 | 29 |
| 44 | EGKPVHVSPGQLNAEAYGVK | 14.25 | 520.78 | 737.38 | 29 |
| 45 | EGKPVHVSPGQLNAEAYGVK | 14.25 | 520.78 | 834.45 | 29 |
| 46 | EGKPVHVTPGQLDAEAYGVK | 14.72 | 524.53 | 848.46 | 29 |
| 47 | EGKPVHVTPGQLDAEAYGVK | 14.72 | 699.03 | 852.41 | 39 |
| 48 | EGKPVHVTPGQLDAEAYGVK | 14.72 | 699.03 | 1247.63 | 39 |
| 49 | EGKPVYVSPGQLDAEAYGVK | 16.73 | 703.03 | 852.41 | 39 |
| 50 | EGKPVYVSPGQLDAEAYGVK | 16.73 | 703.03 | 860.45 | 39 |
| 51 | EGKPVYVSPGQLDAEAYGVK | 16.73 | 703.03 | 1247.63 | 39 |
| 52 | ESGASVSEQTLFDIGSVSK | 20.37 | 970.98 | 976.42 | 48 |
| 53 | ESGASVSEQTLFDIGSVSK | 20.37 | 970.98 | 1066.58 | 48 |
| 54 | ESGASVSEQTLFDIGSVSK | 20.37 | 970.98 | 1194.64 | 48 |
| 55 | FSDPVTK | 11.61 | 397.21 | 559.31 | 22 |
| 56 | FSDPVTK | 11.61 | 397.21 | 646.34 | 22 |
| 57 | FSDPVTK | 11.61 | 397.21 | 647.3 | 22 |
| 58 | FYQNWQPQWAPGAK | 18.61 | 860.92 | 867.38 | 43 |
| 59 | FYQNWQPQWAPGAK | 18.61 | 860.92 | 982.51 | 43 |
| 60 | FYQNWQPQWAPGAK | 18.61 | 860.92 | 1168.59 | 43 |
| 61 | FYQNWQPQWTPGAK | 18.53 | 875.92 | 884.46 | 44 |
| 62 | FYQNWQPQWTPGAK | 18.53 | 875.92 | 1012.52 | 44 |

TABLE 23-continued

| Transition number | Peptide | Retention time (minutes) | (m/z) filtered in Q1 | (m/z) filtered in Q3 | Collision energy (eV) |
|---|---|---|---|---|---|
| 63 | FYQNWQPQWTPGAK | 18.53 | 875.92 | 1198.6 | 44 |
| 64 | HAPWLK | 11.85 | 376.22 | 543.33 | 22 |
| 65 | HAPWLK | 11.85 | 376.22 | 605.32 | 22 |
| 66 | HAPWLK | 11.85 | 376.22 | 614.37 | 22 |
| 67 | IPDDVR | 9.9 | 357.69 | 504.24 | 21 |
| 68 | IPDDVR | 9.9 | 357.69 | 540.27 | 21 |
| 69 | IPDDVR | 9.9 | 357.69 | 601.29 | 21 |
| 70 | LAHTWIK | 12.56 | 434.76 | 547.32 | 24 |
| 71 | LAHTWIK | 12.56 | 434.76 | 684.38 | 24 |
| 72 | LAHTWIK | 12.56 | 434.76 | 755.42 | 24 |
| 73 | LAHTWITVPENEQK | 15.87 | 555.96 | 609.31 | 32 |
| 74 | LAHTWITVPENEQK | 15.87 | 555.96 | 744.35 | 32 |
| 75 | LAHTWITVPENEQK | 15.87 | 555.96 | 823.45 | 32 |
| 76 | LAHTWITVPQSEQK | 15.75 | 546.63 | 1029.56 | 31 |
| 77 | LAHTWITVPQSEQK | 15.75 | 819.44 | 1029.56 | 41 |
| 78 | LAHTWITVPQSEQK | 15.75 | 819.44 | 1215.64 | 41 |
| 79 | LDAEAYGVK | 12.86 | 483.25 | 537.3 | 26 |
| 80 | LDAEAYGVK | 12.86 | 483.25 | 737.38 | 26 |
| 81 | LDAEAYGVK | 12.86 | 483.25 | 852.41 | 26 |
| 82 | LLHLATYTAGGLPLK | 19.26 | 523.31 | 584.38 | 30 |
| 83 | LLHLATYTAGGLPLK | 19.26 | 523.31 | 655.41 | 30 |
| 84 | LLHLATYTAGGLPLK | 19.26 | 523.31 | 756.46 | 30 |
| 85 | LLHLATYTAGGLPLQFPDDVR | 22.76 | 575.06 | 601.29 | 32 |
| 86 | LLHLATYTAGGLPLQFPDDVR | 22.76 | 766.41 | 1086.56 | 42 |
| 87 | LLHLATYTAGGLPLQFPDDVR | 22.76 | 766.41 | 1098.59 | 42 |
| 88 | NYAWGYR | 14.18 | 465.22 | 581.28 | 25 |
| 89 | NYAWGYR | 14.18 | 465.22 | 652.32 | 25 |
| 90 | NYAWGYR | 14.18 | 465.22 | 815.38 | 25 |
| 91 | NYPIPAR | 12.32 | 415.73 | 456.29 | 23 |
| 92 | NYPIPAR | 12.32 | 415.73 | 553.35 | 23 |
| 93 | NYPIPAR | 12.32 | 415.73 | 716.41 | 23 |
| 94 | NYPNEAR | 6.92 | 432.2 | 489.21 | 24 |
| 95 | NYPNEAR | 6.92 | 432.2 | 586.29 | 24 |
| 96 | NYPNEAR | 6.92 | 432.2 | 749.36 | 24 |
| 97 | SLC[CAM]C[CAM]ALLLTAPLSTFAAAK | 26.05 | 670.02 | 905.51 | 38 |
| 98 | SLC[CAM]C[CAM]ALLLTAPLSTFAAAK | 26.05 | 1004.53 | 1077.59 | 49 |
| 99 | SLC[CAM]C[CAM]ALLLTAPLSTFAAAK | 26.05 | 1004.53 | 1190.68 | 49 |
| 100 | SNVTDMAR | 10.56 | 447.21 | 492.22 | 25 |

TABLE 23-continued

| Transition number | Peptide | Retention time (minutes) | (m/z) filtered in Q1 | (m/z) filtered in Q3 | Collision energy (eV) |
|---|---|---|---|---|---|
| 101 | SNVTDMAR | 10.56 | 447.21 | 593.27 | 25 |
| 102 | SNVTDMAR | 10.56 | 447.21 | 692.34 | 25 |
| 103 | TALLHFYQNWQPQWAPGAK | 21.7 | 752.72 | 854.45 | 42 |
| 104 | TALLHFYQNWQPQWAPGAK | 21.7 | 752.72 | 974.51 | 42 |
| 105 | TALLHFYQNWQPQWAPGAK | 21.7 | 752.72 | 1088.55 | 42 |
| 106 | TDSIINGSDSK | 10.86 | 568.78 | 720.35 | 30 |
| 107 | TDSIINGSDSK | 10.86 | 568.78 | 833.44 | 30 |
| 108 | TDSIINGSDSK | 10.86 | 568.78 | 920.47 | 30 |
| 109 | TFIGVLGGDAIAR | 20.29 | 645.36 | 659.35 | 33 |
| 110 | TFIGVLGGDAIAR | 20.29 | 645.36 | 772.43 | 33 |
| 111 | TFIGVLGGDAIAR | 20.29 | 645.36 | 928.52 | 33 |
| 112 | TFNGVLGGDC[CAM]IAR | 16.85 | 690.34 | 748.34 | 35 |
| 113 | TFNGVLGGDC[CAM]IAR | 16.85 | 690.34 | 861.42 | 35 |
| 114 | TFNGVLGGDC[CAM]IAR | 16.85 | 690.34 | 1131.56 | 35 |
| 115 | TFNGVLGGEAIAR | 17.2 | 435.57 | 673.36 | 26 |
| 116 | TFNGVLGGEAIAR | 17.2 | 652.85 | 673.36 | 34 |
| 117 | TFNGVLGGEAIAR | 17.2 | 652.85 | 786.45 | 34 |
| 118 | TGSTVGFGSYVAFVPEK | 20.65 | 873.44 | 1039.55 | 43 |
| 119 | TGSTVGFGSYVAFVPEK | 20.65 | 873.44 | 1096.57 | 43 |
| 120 | TGSTVGFGSYVAFVPEK | 20.65 | 873.44 | 1243.64 | 43 |
| 121 | TGYTGGFGSYVAFVPEK | 20.58 | 890.43 | 1039.55 | 44 |
| 122 | TGYTGGFGSYVAFVPEK | 20.58 | 890.43 | 1096.57 | 44 |
| 123 | TGYTGGFGSYVAFVPEK | 20.58 | 890.43 | 1243.64 | 44 |
| 124 | TLQQGIELAQSR | 15.04 | 448.58 | 461.25 | 26 |
| 125 | TLQQGIELAQSR | 15.04 | 672.37 | 703.37 | 35 |
| 126 | TLQQGIELAQSR | 15.04 | 672.37 | 873.48 | 35 |
| 127 | TSSADLLAFVK | 20.76 | 576.32 | 805.48 | 30 |
| 128 | TSSADLLAFVK | 20.76 | 576.32 | 876.52 | 30 |
| 129 | TSSADLLAFVK | 20.76 | 576.32 | 963.55 | 30 |
| 130 | TSSADLLR | 12.72 | 431.73 | 587.35 | 24 |
| 131 | TSSADLLR | 12.72 | 431.73 | 674.38 | 24 |
| 132 | TSSADLLR | 12.72 | 431.73 | 761.42 | 24 |
| 133 | TYYFTWGK | 18.46 | 533.26 | 801.39 | 28 |
| 134 | TYYFTWGK | 18.46 | 533.26 | 919.4 | 28 |
| 135 | TYYFTWGK | 18.46 | 533.26 | 964.46 | 28 |
| 136 | VAALPAVEVNPPAPAVK | 18.04 | 821.98 | 964.55 | 41 |
| 137 | VAALPAVEVNPPAPAVK | 18.04 | 821.98 | 1021.57 | 41 |
| 138 | VAALPAVEVNPPAPAVK | 18.04 | 821.98 | 1120.64 | 41 |

TABLE 23-continued

| Transition number | Peptide | Retention time (minutes) | (m/z) filtered in Q1 | (m/z) filtered in Q3 | Collision energy (eV) |
|---|---|---|---|---|---|
| 139 | VAFAALPAVEVNPPAPAVK | 21.03 | 621.02 | 679.41 | 35 |
| 140 | VAFAALPAVEVNPPAPAVK | 21.03 | 621.02 | 793.46 | 35 |
| 141 | VAFAALPAVEVNPPAPAVK | 21.03 | 931.03 | 1021.57 | 46 |
| 142 | VALAAIPAVEVNPPAPAVK | 20.17 | 457.52 | 679.41 | 26 |
| 143 | VALAAIPAVEVNPPAPAVK | 20.17 | 609.7 | 679.41 | 34 |
| 144 | VALAAIPAVEVNPPAPAVK | 20.17 | 609.7 | 793.46 | 34 |
| 145 | VALAALHTVEVNPPAPAVK | 18 | 475.03 | 582.36 | 27 |
| 146 | VALAALHTVEVNPPAPAVK | 18 | 475.03 | 679.41 | 27 |
| 147 | VALAALHTVEVNPPAPAVK | 18 | 633.03 | 679.41 | 36 |
| 148 | VALAALPAVEINPPAPAVK | 21.5 | 614.37 | 679.41 | 35 |
| 149 | VALAALPAVEINPPAPAVK | 21.5 | 614.37 | 793.46 | 35 |
| 150 | VALAALPAVEINPPAPAVK | 21.5 | 614.37 | 935.56 | 35 |
| 151 | VALAALPTVEVNPPAPAVK | 20.41 | 619.7 | 679.41 | 35 |
| 152 | VALAALPTVEVNPPAPAVK | 20.41 | 619.7 | 793.46 | 35 |
| 153 | VALAALPTVEVNPPAPAVK | 20.41 | 619.7 | 1021.57 | 35 |
| 154 | VAPAVEVNPPAPAVK | 15.16 | 729.92 | 793.46 | 37 |
| 155 | VAPAVEVNPPAPAVK | 15.16 | 729.92 | 892.53 | 37 |
| 156 | VAPAVEVNPPAPAVK | 15.16 | 729.92 | 1021.57 | 37 |
| 157 | VEAYWR | 13.37 | 412.21 | 524.26 | 23 |
| 158 | VEAYWR | 13.37 | 412.21 | 595.3 | 23 |
| 159 | VEAYWR | 13.37 | 412.21 | 724.34 | 23 |
| 160 | VILEANPTAAPR | 14.25 | 417.91 | 612.35 | 25 |
| 161 | VILEANPTAAPR | 14.25 | 626.36 | 797.43 | 33 |
| 162 | VILEANPTAAPR | 14.25 | 626.36 | 1039.55 | 33 |
| 163 | VSLEANPTAAPR | 13.15 | 613.33 | 726.39 | 32 |
| 164 | VSLEANPTAAPR | 13.15 | 613.33 | 797.43 | 32 |
| 165 | VSLEANPTAAPR | 13.15 | 613.33 | 926.47 | 32 |
| 166 | WIQVNMDASR | 16.68 | 610.3 | 693.3 | 32 |
| 167 | WIQVNMDASR | 16.68 | 610.3 | 792.37 | 32 |
| 168 | WIQVNMDASR | 16.68 | 610.3 | 920.43 | 32 |
| 169 | WVQANMDASR | 12.82 | 589.27 | 764.34 | 31 |
| 170 | WVQANMDASR | 12.82 | 589.27 | 892.39 | 31 |
| 171 | WVQANMDASR | 12.82 | 589.27 | 991.46 | 31 |
| 172 | WVQVNMDASR | 15.27 | 603.29 | 792.37 | 32 |
| 173 | WVQVNMDASR | 15.27 | 603.29 | 920.43 | 32 |
| 174 | WVQVNMDASR | 15.27 | 603.29 | 1019.49 | 32 |
| 175 | YWSELTGK | 14.9 | 492.25 | 547.31 | 27 |

TABLE 23-continued

| Transition number | Peptide | Retention time (minutes) | (m/z) filtered in Q1 | (m/z) filtered in Q3 | Collision energy (eV) |
|---|---|---|---|---|---|
| 176 | YWSELTGK | 14.9 | 492.25 | 634.34 | 27 |
| 177 | YWSELTGK | 14.9 | 492.25 | 820.42 | 27 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 18

Identification of a Resistance to CTX-M Beta-Lactams

The samples corresponding to a species able to comprise a CTX-M resistance mechanism can be detected by employing the following method.

Each sample is treated according to example 5, then analysed according to example 6 by detecting the peptides from TABLE 24 instead of the peptides from TABLE 3.

TABLE 24

| Transition number | Peptide | Retention time (minutes) | (m/z) filtered in Q1 | (m/z) filtered in Q3 | Collision energy (eV) |
|---|---|---|---|---|---|
| 1 | AGADVASLR | 11.83 | 430.24 | 446.27 | 24 |
| 2 | AGADVASLR | 11.83 | 430.24 | 485.24 | 24 |
| 3 | AGADVASLR | 11.83 | 430.24 | 660.37 | 24 |
| 4 | AGLPASWVVGDK | 18.32 | 600.32 | 790.41 | 31 |
| 5 | AGLPASWVVGDK | 18.32 | 600.32 | 861.45 | 31 |
| 6 | AGLPASWVVGDK | 18.32 | 600.32 | 958.5 | 31 |
| 7 | AGLPTSWTAGDK | 15.73 | 602.3 | 764.36 | 32 |
| 8 | AGLPTSWTAGDK | 15.73 | 602.3 | 865.41 | 32 |
| 9 | AGLPTSWTAGDK | 15.73 | 602.3 | 962.46 | 32 |
| 10 | AGLPTSWTVGDR | 17.31 | 630.32 | 820.39 | 33 |
| 11 | AGLPTSWTVGDR | 17.31 | 630.32 | 921.44 | 33 |
| 12 | AGLPTSWTVGDR | 17.31 | 630.32 | 1018.5 | 33 |
| 13 | AGLPTSWVVGDK | 18.62 | 615.33 | 790.41 | 32 |
| 14 | AGLPTSWVVGDK | 18.62 | 615.33 | 891.46 | 32 |
| 15 | AGLPTSWVVGDK | 18.62 | 615.33 | 988.51 | 32 |
| 16 | AIGDDTFR | 12.79 | 447.72 | 653.29 | 25 |
| 17 | AIGDDTFR | 12.79 | 447.72 | 710.31 | 25 |
| 18 | AIGDDTFR | 12.79 | 447.72 | 823.39 | 25 |
| 19 | AMAVAAVLK | 16.36 | 437.26 | 501.34 | 24 |
| 20 | AMAVAAVLK | 16.36 | 437.26 | 600.41 | 24 |
| 21 | AMAVAAVLK | 16.36 | 437.26 | 671.45 | 24 |
| 22 | APLILVTYFTQPEQK | 23.95 | 583.33 | 730.37 | 33 |
| 23 | APLILVTYFTQPEQK | 23.95 | 874.49 | 1040.5 | 43 |
| 24 | APLILVTYFTQPEQK | 23.95 | 874.49 | 1141.55 | 43 |
| 25 | APLVLVTYFTQPEPK | 23.37 | 568.32 | 699.37 | 32 |

TABLE 24-continued

| Transition number | Peptide | Retention time (minutes) | (m/z) filtered in Q1 | (m/z) filtered in Q3 | Collision energy (eV) |
|---|---|---|---|---|---|
| 26 | APLVLVTYFTQPEPK | 23.37 | 568.32 | 846.44 | 32 |
| 27 | APLVLVTYFTQPEPK | 23.37 | 851.97 | 1110.55 | 42 |
| 28 | APLVLVTYFTQPQQNAENR | 22.93 | 730.38 | 956.45 | 41 |
| 29 | APLVLVTYFTQPQQNAENR | 22.93 | 1095.07 | 1185.56 | 53 |
| 30 | APLVLVTYFTQPQQNAENR | 22.93 | 1095.07 | 1233.69 | 53 |
| 31 | APLVLVTYFTQPQQNAER | 23.02 | 692.37 | 745.36 | 39 |
| 32 | APLVLVTYFTQPQQNAER | 23.02 | 692.37 | 842.41 | 39 |
| 33 | APLVLVTYFTQPQQNAER | 23.02 | 692.37 | 857.51 | 39 |
| 34 | APLVLVTYFTQSEPK | 23.53 | 564.98 | 689.35 | 32 |
| 35 | APLVLVTYFTQSEPK | 23.53 | 846.96 | 1100.53 | 42 |
| 36 | APLVLVTYFTQSEPK | 23.53 | 846.96 | 1199.59 | 42 |
| 37 | AQLVAWLK | 19.52 | 464.78 | 517.31 | 25 |
| 38 | AQLVAWLK | 19.52 | 464.78 | 616.38 | 25 |
| 39 | AQLVAWLK | 19.52 | 464.78 | 729.47 | 25 |
| 40 | AQLVMWLK | 20.53 | 494.79 | 577.32 | 27 |
| 41 | AQLVMWLK | 20.53 | 494.79 | 676.39 | 27 |
| 42 | AQLVMWLK | 20.53 | 494.79 | 789.47 | 27 |
| 43 | ASDLVNYNPIAEK | 16.72 | 717.37 | 834.44 | 37 |
| 44 | ASDLVNYNPIAEK | 16.72 | 717.37 | 948.48 | 37 |
| 45 | ASDLVNYNPIAEK | 16.72 | 717.37 | 1047.55 | 37 |
| 46 | DFLAAAAK | 14.5 | 403.72 | 431.26 | 23 |
| 47 | DFLAAAAK | 14.5 | 403.72 | 518.26 | 23 |
| 48 | DFLAAAAK | 14.5 | 403.72 | 544.35 | 23 |
| 49 | DILASAAK | 12.62 | 394.73 | 447.26 | 22 |
| 50 | DILASAAK | 12.62 | 394.73 | 560.34 | 22 |
| 51 | DILASAAK | 12.62 | 394.73 | 571.31 | 22 |
| 52 | DNTQVLYR | 12.19 | 504.76 | 550.33 | 27 |
| 53 | DNTQVLYR | 12.19 | 504.76 | 678.39 | 27 |
| 54 | DNTQVLYR | 12.19 | 504.76 | 779.44 | 27 |
| 55 | DTTTPLAMAQALR | 19.92 | 694.86 | 760.41 | 36 |
| 56 | DTTTPLAMAQALR | 19.92 | 694.86 | 873.5 | 36 |
| 57 | DTTTPLAMAQALR | 19.92 | 694.86 | 970.55 | 36 |
| 58 | DTTTPLAMAQSLR | 19.22 | 702.86 | 776.41 | 36 |
| 59 | DTTTPLAMAQSLR | 19.22 | 702.86 | 889.49 | 36 |
| 60 | DTTTPLAMAQSLR | 19.22 | 702.86 | 986.55 | 36 |
| 61 | DTTTPLAMAQTLR | 18.99 | 709.87 | 719.39 | 36 |
| 62 | DTTTPLAMAQTLR | 18.99 | 709.87 | 790.42 | 36 |
| 63 | DTTTPLAMAQTLR | 18.99 | 709.87 | 1000.56 | 36 |

TABLE 24-continued

| Transition number | Peptide | Retention time (minutes) | (m/z) filtered in Q1 | (m/z) filtered in Q3 | Collision energy (eV) |
|---|---|---|---|---|---|
| 64 | DVLAAAAR | 12.11 | 393.73 | 459.27 | 22 |
| 65 | DVLAAAAR | 12.11 | 393.73 | 572.35 | 22 |
| 66 | DVLAAAAR | 12.11 | 393.73 | 671.42 | 22 |
| 67 | EIGDETFR | 12.99 | 483.73 | 552.28 | 26 |
| 68 | EIGDETFR | 12.99 | 483.73 | 667.3 | 26 |
| 69 | EIGDETFR | 12.99 | 483.73 | 724.33 | 26 |
| 70 | EQLVTWLK | 19.13 | 508.79 | 547.32 | 27 |
| 71 | EQLVTWLK | 19.13 | 508.79 | 646.39 | 27 |
| 72 | EQLVTWLK | 19.13 | 508.79 | 759.48 | 27 |
| 73 | GNTTGSASIQAGLPK | 13.81 | 701.37 | 813.48 | 36 |
| 74 | GNTTGSASIQAGLPK | 13.81 | 701.37 | 1028.57 | 36 |
| 75 | GNTTGSASIQAGLPK | 13.81 | 701.37 | 1129.62 | 36 |
| 76 | HDVLASAAK | 9.32 | 456.25 | 659.41 | 25 |
| 77 | HDVLASAAK | 9.32 | 456.25 | 765.39 | 25 |
| 78 | HDVLASAAK | 9.32 | 456.25 | 774.44 | 25 |
| 79 | HDVLASAAR | 9.88 | 470.25 | 588.35 | 26 |
| 80 | HDVLASAAR | 9.88 | 470.25 | 687.41 | 26 |
| 81 | HDVLASAAR | 9.88 | 470.25 | 802.44 | 26 |
| 82 | HLTLGSALGETQR | 15.07 | 691.87 | 918.46 | 35 |
| 83 | HLTLGSALGETQR | 15.07 | 691.87 | 1031.55 | 35 |
| 84 | HLTLGSALGETQR | 15.07 | 691.87 | 1132.6 | 35 |
| 85 | LAELEQQSGGR | 11.17 | 594.3 | 761.35 | 31 |
| 86 | LAELEQQSGGR | 11.17 | 594.3 | 874.44 | 31 |
| 87 | LAELEQQSGGR | 11.17 | 594.3 | 1003.48 | 31 |
| 88 | LAGLER | 11.22 | 329.7 | 474.27 | 20 |
| 89 | LAGLER | 11.22 | 329.7 | 484.28 | 20 |
| 90 | LAGLER | 11.22 | 329.7 | 545.3 | 20 |
| 91 | LDGTEPTLNTAIPGDPR | 16.6 | 589.64 | 1053.57 | 33 |
| 92 | LDGTEPTLNTAIPGDPR | 16.6 | 883.95 | 1053.57 | 44 |
| 93 | LDGTEPTLNTAIPGDPR | 16.6 | 883.95 | 1154.62 | 44 |
| 94 | LGVALIDTADNAQTLYR | 20.27 | 917.49 | 980.48 | 45 |
| 95 | LGVALIDTADNAQTLYR | 20.27 | 917.49 | 1051.52 | 45 |
| 96 | LGVALIDTADNAQTLYR | 20.27 | 917.49 | 1152.56 | 45 |
| 97 | LGVALIDTADNTHVLYR | 19.46 | 624.34 | 801.42 | 35 |
| 98 | LGVALIDTADNTHVLYR | 19.46 | 624.34 | 902.48 | 35 |
| 99 | LGVALIDTADNTHVLYR | 19.46 | 624.34 | 1189.6 | 35 |
| 100 | LGVALIDTK | 16.93 | 465.29 | 589.36 | 25 |
| 101 | LGVALIDTK | 16.93 | 465.29 | 660.39 | 25 |

TABLE 24-continued

| Transition number | Peptide | Retention time (minutes) | (m/z) filtered in Q1 | (m/z) filtered in Q3 | Collision energy (eV) |
|---|---|---|---|---|---|
| 102 | LGVALIDTK | 16.93 | 465.29 | 816.48 | 25 |
| 103 | LGVALINTADNSR | 16.92 | 672.37 | 777.35 | 35 |
| 104 | LGVALINTADNSR | 16.92 | 672.37 | 890.43 | 35 |
| 105 | LGVALINTADNSR | 16.92 | 672.37 | 1003.52 | 35 |
| 106 | LGVALINTADNTQTLYR | 19.63 | 621.67 | 1081.53 | 35 |
| 107 | LGVALINTADNTQTLYR | 19.63 | 932 | 1081.53 | 46 |
| 108 | LGVALINTADNTQTLYR | 19.63 | 932 | 1182.57 | 46 |
| 109 | LGVPLIDTADNTQVLYR | 21.54 | 944.51 | 1008.51 | 47 |
| 110 | LGVPLIDTADNTQVLYR | 21.54 | 944.51 | 1079.55 | 47 |
| 111 | LGVPLIDTADNTQVLYR | 21.54 | 944.51 | 1180.6 | 47 |
| 112 | LIAHLGGPGK | 12.27 | 321.53 | 358.21 | 20 |
| 113 | LIAHLGGPGK | 12.27 | 321.53 | 415.23 | 20 |
| 114 | LIAHLGGPGK | 12.27 | 321.53 | 528.31 | 20 |
| 115 | LIAQLGGQGGVTAFAR | 18.73 | 779.94 | 963.5 | 39 |
| 116 | LIAQLGGQGGVTAFAR | 18.73 | 779.94 | 1020.52 | 39 |
| 117 | LIAQLGGQGGVTAFAR | 18.73 | 779.94 | 1133.61 | 39 |
| 118 | LISHVGGPASVTAFAR | 16.27 | 528.29 | 565.31 | 30 |
| 119 | LISHVGGPASVTAFAR | 16.27 | 528.29 | 664.38 | 30 |
| 120 | LISHVGGPASVTAFAR | 16.27 | 791.94 | 1033.54 | 40 |
| 121 | LLLNQR | 12.81 | 378.74 | 417.22 | 22 |
| 122 | LLLNQR | 12.81 | 378.74 | 530.3 | 22 |
| 123 | LLLNQR | 12.81 | 378.74 | 643.39 | 22 |
| 124 | NLTLGNALGDTQR | 16.67 | 686.86 | 931.46 | 35 |
| 125 | NLTLGNALGDTQR | 16.67 | 686.86 | 1044.54 | 35 |
| 126 | NLTLGNALGDTQR | 16.67 | 686.86 | 1145.59 | 35 |
| 127 | NLTLGSALGETQR | 17.15 | 453.91 | 590.29 | 27 |
| 128 | NLTLGSALGETQR | 17.15 | 680.36 | 918.46 | 35 |
| 129 | NLTLGSALGETQR | 17.15 | 680.36 | 1031.55 | 35 |
| 130 | QLGDDTFR | 13.1 | 476.23 | 653.29 | 26 |
| 131 | QLGDDTFR | 13.1 | 476.23 | 710.31 | 26 |
| 132 | QLGDDTFR | 13.1 | 476.23 | 823.39 | 26 |
| 133 | SDLVNYSPIAEK | 16.24 | 668.34 | 807.42 | 34 |
| 134 | SDLVNYSPIAEK | 16.24 | 668.34 | 921.47 | 34 |
| 135 | SDLVNYSPIAEK | 16.24 | 668.34 | 1020.54 | 34 |
| 136 | SESEPSLLNQR | 13.8 | 630.31 | 730.42 | 33 |
| 137 | SESEPSLLNQR | 13.8 | 630.31 | 827.47 | 33 |
| 138 | SESEPSLLNQR | 13.8 | 630.31 | 1043.55 | 33 |
| 139 | SLGDESFR | 12.8 | 455.72 | 653.29 | 25 |

TABLE 24-continued

| Transition number | Peptide | Retention time (minutes) | (m/z) filtered in Q1 | (m/z) filtered in Q3 | Collision energy (eV) |
|---|---|---|---|---|---|
| 140 | SLGDESFR | 12.8 | 455.72 | 710.31 | 25 |
| 141 | SLGDESFR | 12.8 | 455.72 | 823.39 | 25 |
| 142 | SSDLINYNPIAEK | 17.68 | 732.37 | 834.44 | 37 |
| 143 | SSDLINYNPIAEK | 17.68 | 732.37 | 948.48 | 37 |
| 144 | SSDLINYNPIAEK | 17.68 | 732.37 | 1061.56 | 37 |
| 145 | SSDLINYNPITEK | 17.72 | 747.38 | 864.45 | 38 |
| 146 | SSDLINYNPITEK | 17.72 | 747.38 | 978.49 | 38 |
| 147 | SSDLINYNPITEK | 17.72 | 747.38 | 1091.57 | 38 |
| 148 | SWGVGDK | 11.6 | 374.68 | 475.25 | 21 |
| 149 | SWGVGDK | 11.6 | 374.68 | 602.26 | 21 |
| 150 | SWGVGDK | 11.6 | 374.68 | 661.33 | 21 |
| 151 | TELTLNTAIPGDPR | 17.63 | 749.4 | 826.44 | 38 |
| 152 | TELTLNTAIPGDPR | 17.63 | 749.4 | 940.48 | 38 |
| 153 | TELTLNTAIPGDPR | 17.63 | 749.4 | 957.53 | 38 |
| 154 | TEPTLNSAIPGDPR | 15.33 | 734.38 | 812.43 | 37 |
| 155 | TEPTLNSAIPGDPR | 15.33 | 734.38 | 926.47 | 37 |
| 156 | TEPTLNSAIPGDPR | 15.33 | 734.38 | 1237.65 | 37 |
| 157 | TEQTLNTAIPGDPR | 14.47 | 756.89 | 940.48 | 38 |
| 158 | TEQTLNTAIPGDPR | 14.47 | 756.89 | 972.5 | 38 |
| 159 | TEQTLNTAIPGDPR | 14.47 | 756.89 | 1154.62 | 38 |
| 160 | TESTLNTAIPGDPR | 14.52 | 736.37 | 940.48 | 37 |
| 161 | TESTLNTAIPGDPR | 14.52 | 736.37 | 1053.57 | 37 |
| 162 | TESTLNTAIPGDPR | 14.52 | 736.37 | 1154.62 | 37 |
| 163 | TETTLNTAIPGDPR | 14.88 | 743.38 | 826.44 | 38 |
| 164 | TETTLNTAIPGDPR | 14.88 | 743.38 | 940.48 | 38 |
| 165 | TETTLNTAIPGDPR | 14.88 | 743.38 | 945.49 | 38 |
| 166 | TGSC[CAM]DYGTTNDIAVIWPK | 20.38 | 999.47 | 1055.59 | 49 |
| 167 | TGSC[CAM]DYGTTNDIAVIWPK | 20.38 | 999.47 | 1156.64 | 49 |
| 168 | TGSC[CAM]DYGTTNDIAVIWPK | 20.38 | 999.47 | 1172.42 | 49 |
| 169 | TGSC[CAM]GYGTTNDIAVIWPK | 20.21 | 970.46 | 1055.59 | 48 |
| 170 | TGSC[CAM]GYGTTNDIAVIWPK | 20.21 | 970.46 | 1114.41 | 48 |
| 171 | TGSC[CAM]GYGTTNDIAVIWPK | 20.21 | 970.46 | 1156.64 | 48 |
| 172 | TGSGDYGTTNDIAVIWPEGR | 20.27 | 1055 | 1069.41 | 51 |
| 173 | TGSGDYGTTNDIAVIWPEGR | 20.27 | 1055 | 1155.62 | 51 |
| 174 | TGSGDYGTTNDIAVIWPEGR | 20.27 | 1055 | 1182.49 | 51 |
| 175 | TGSGGYGTTNDIAVIWPEGR | 20.16 | 684.33 | 757.4 | 38 |
| 176 | TGSGGYGTTNDIAVIWPEGR | 20.16 | 684.33 | 927.5 | 38 |
| 177 | TGSGGYGTTNDIAVIWPEGR | 20.16 | 684.33 | 1011.4 | 38 |

TABLE 24-continued

| Transition number | Peptide | Retention time (minutes) | (m/z) filtered in Q1 | (m/z) filtered in Q3 | Collision energy (eV) |
|---|---|---|---|---|---|
| 178 | TGSGGYGTTNDIAVIWPQGR | 19.81 | 684 | 756.42 | 38 |
| 179 | TGSGGYGTTNDIAVIWPQGR | 19.81 | 684 | 926.52 | 38 |
| 180 | TGSGGYGTTNDIAVIWPQGR | 19.81 | 684 | 1011.4 | 38 |
| 181 | TIGDDTFR | 12.86 | 462.72 | 538.26 | 25 |
| 182 | TIGDDTFR | 12.86 | 462.72 | 653.29 | 25 |
| 183 | TIGDDTFR | 12.86 | 462.72 | 710.31 | 25 |
| 184 | TQLVTWLK | 19.07 | 494.79 | 646.39 | 27 |
| 185 | TQLVTWLK | 19.07 | 494.79 | 759.48 | 27 |
| 186 | TQLVTWLK | 19.07 | 494.79 | 887.53 | 27 |
| 187 | VEIKPSDLINYNPIAEK | 20.21 | 648.35 | 769.41 | 36 |
| 188 | VEIKPSDLINYNPIAEK | 20.21 | 648.35 | 882.49 | 36 |
| 189 | VEIKPSDLINYNPIAEK | 20.21 | 648.35 | 948.48 | 36 |
| 190 | VEIKPSDLVNYNPIAEK | 19.33 | 643.68 | 769.41 | 36 |
| 191 | VEIKPSDLVNYNPIAEK | 19.33 | 643.68 | 882.49 | 36 |
| 192 | VEIKPSDLVNYNPIAEK | 19.33 | 643.68 | 948.48 | 36 |
| 193 | VIGDDTFR | 13.3 | 461.73 | 538.26 | 25 |
| 194 | VIGDDTFR | 13.3 | 461.73 | 710.31 | 25 |
| 195 | VIGDDTFR | 13.3 | 461.73 | 823.39 | 25 |
| 196 | VMAAAALLK | 17.06 | 444.27 | 586.39 | 25 |
| 197 | VMAAAALLK | 17.06 | 444.27 | 657.43 | 25 |
| 198 | VMAAAALLK | 17.06 | 444.27 | 788.47 | 25 |
| 199 | VMAAAAVLEQSETQK | 16.62 | 788.41 | 962.48 | 40 |
| 200 | VMAAAAVLEQSETQK | 16.62 | 788.41 | 1061.55 | 40 |
| 201 | VMAAAAVLEQSETQK | 16.62 | 788.41 | 1132.58 | 40 |
| 202 | WAKPSGAVGDVAQR | 12.73 | 481.26 | 628.34 | 28 |
| 203 | WAKPSGAVGDVAQR | 12.73 | 481.26 | 645.33 | 28 |
| 204 | WAKPSGAVGDVAQR | 12.73 | 481.26 | 698.36 | 28 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 19

Identification of a Resistance to DHA Beta-Lactams

The samples corresponding to a species able to comprise a DHA resistance mechanism can be detected by employing the following method.

Each sample is treated according to example 5, then analysed according to example 6 by detecting the peptides from TABLE 25 instead of the peptides from TABLE 3.

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 20

Identification of a Resistance to FOX Beta-Lactams

The samples corresponding to a species able to comprise a FOX resistance mechanism can be detected by employing the following method.

Each sample is treated according to example 5, then analysed according to example 6 by detecting the peptides from TABLE 26 instead of the peptides from TABLE 3.

TABLE 25

| Transition number | Peptide | Retention time (minutes) | (m/z) filtered in Q1 | (m/z) filtered in Q3 | Collision energy (eV) |
|---|---|---|---|---|---|
| 1 | ADLLHFYQQWQPSR | 20.9 | 596.97 | 673.34 | 34 |
| 2 | ADLLHFYQQWQPSR | 20.9 | 596.97 | 988.49 | 34 |
| 3 | ADLLHFYQQWQPSR | 20.9 | 596.97 | 1116.55 | 34 |
| 4 | AELLHFYQQWQPSR | 19.23 | 601.64 | 673.34 | 34 |
| 5 | AELLHFYQQWQPSR | 19.23 | 601.64 | 801.4 | 34 |
| 6 | AELLHFYQQWQPSR | 19.23 | 601.64 | 1130.56 | 34 |
| 7 | EMMLNDPAEK | 13.78 | 589.26 | 786.4 | 31 |
| 8 | EMMLNDPAEK | 13.78 | 589.26 | 917.44 | 31 |
| 9 | EMMLNDPAEK | 13.78 | 589.26 | 1048.48 | 31 |
| 10 | GKPYYFNYGFADVQAK | 18.12 | 623.31 | 631.34 | 35 |
| 11 | GKPYYFNYGFADVQAK | 18.12 | 623.31 | 778.41 | 35 |
| 12 | GKPYYFNYGFADVQAK | 18.12 | 623.31 | 835.43 | 35 |
| 13 | TAAINQGLGWEMYDWPQQK | 21.57 | 746.02 | 964.45 | 41 |
| 14 | TAAINQGLGWEMYDWPQQK | 21.57 | 746.02 | 1095.49 | 41 |
| 15 | TAAINQGLGWEMYDWPQQK | 21.57 | 1118.53 | 1224.54 | 54 |
| 16 | WAEMNIEPSR | 15.85 | 616.79 | 715.37 | 32 |
| 17 | WAEMNIEPSR | 15.85 | 616.79 | 975.46 | 32 |
| 18 | WAEMNIEPSR | 15.85 | 616.79 | 1046.49 | 32 |

TABLE 26

| Transition number | Peptide | Retention time (minutes) | (m/z) filtered in Q1 | (m/z) filtered in Q3 | Collision energy (eV) |
|---|---|---|---|---|---|
| 1 | ATPGVLAAEAYGIK | 17.72 | 680.88 | 751.4 | 35 |
| 2 | ATPGVLAAEAYGIK | 17.72 | 680.88 | 822.44 | 35 |
| 3 | ATPGVLAAEAYGIK | 17.72 | 680.88 | 935.52 | 35 |
| 4 | FAEANMGYQGDAAVK | 14.08 | 786.36 | 908.45 | 40 |
| 5 | FAEANMGYQGDAAVK | 14.08 | 786.36 | 1039.49 | 40 |
| 6 | FAEANMGYQGDAAVK | 14.08 | 786.36 | 1224.57 | 40 |
| 7 | FAEANMGYQGDALVK | 16.35 | 538.59 | 602.35 | 31 |
| 8 | FAEANMGYQGDALVK | 16.35 | 538.59 | 730.41 | 31 |
| 9 | FAEANMGYQGDALVK | 16.35 | 807.38 | 950.49 | 41 |
| 10 | GEAPLTAAVDGIIQPMLK | 25.85 | 912.5 | 1014.57 | 45 |
| 11 | GEAPLTAAVDGIIQPMLK | 25.85 | 912.5 | 1113.63 | 45 |
| 12 | GEAPLTAAVDGIIQPMLK | 25.85 | 912.5 | 1184.67 | 45 |
| 13 | HWSPVYPAGTHR | 12.55 | 469.9 | 541.28 | 27 |
| 14 | HWSPVYPAGTHR | 12.55 | 469.9 | 607.3 | 27 |
| 15 | HWSPVYPAGTHR | 12.55 | 469.9 | 638.34 | 27 |
| 16 | IPGIAVAVLK | 19.45 | 490.83 | 600.41 | 27 |
| 17 | IPGIAVAVLK | 19.45 | 490.83 | 770.51 | 27 |
| 18 | IPGIAVAVLK | 19.45 | 490.83 | 867.57 | 27 |
| 19 | LMSQTLLPK | 16.18 | 515.8 | 699.44 | 28 |
| 20 | LMSQTLLPK | 16.18 | 515.8 | 786.47 | 28 |
| 21 | LMSQTLLPK | 16.18 | 515.8 | 917.51 | 28 |
| 22 | MQTYYR | 10.72 | 431.2 | 602.29 | 24 |
| 23 | MQTYYR | 10.72 | 431.2 | 687.28 | 24 |
| 24 | MQTYYR | 10.72 | 431.2 | 730.35 | 24 |
| 25 | VSHHAPWLK | 11.49 | 537.8 | 614.37 | 29 |
| 26 | VSHHAPWLK | 11.49 | 537.8 | 751.42 | 29 |
| 27 | VSHHAPWLK | 11.49 | 537.8 | 888.48 | 29 |
| 28 | VTPGMLAAEAYGIK | 19 | 710.88 | 822.44 | 36 |
| 29 | VTPGMLAAEAYGIK | 19 | 710.88 | 1123.58 | 36 |
| 30 | VTPGMLAAEAYGIK | 19 | 710.88 | 1220.63 | 36 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 21

Identification of a Resistance to MIR Beta-Lactams

The samples corresponding to a species able to comprise an MIR resistance mechanism can be detected by employing the following method.

Each sample is treated according to example 5, then analysed according to example 6 by detecting the peptides from TABLE 27 instead of the peptides from TABLE 3.

TABLE 27

| Transition number | Peptide | Retention time (minutes) | (m/z) filtered in Q1 | (m/z) filtered in Q3 | Collision energy (eV) |
|---|---|---|---|---|---|
| 1 | AEEAHFAWGYR | 16.38 | 446.21 | 568.77 | 20.9 |
| 2 | AEEAHFAWGYR | 16.36 | 446.21 | 633.29 | 20.9 |
| 3 | AEEAHFAWGYR | 16.36 | 446.21 | 652.32 | 20.9 |
| 4 | DMASWLIANMKPDSLHAPSLK | 24.18 | 775.73 | 811.44 | 31.1 |
| 5 | DMASWLIANMKPDSLHAPSLK | 24.18 | 775.73 | 867.98 | 31.1 |
| 6 | DMASWLIANMKPDSLHAPSLK | 24.18 | 775.73 | 1004.54 | 31.1 |
| 7 | DMASWLIANMKPDSLQAPSLK | 25.04 | 772.73 | 528.29 | 31 |
| 8 | DMASWLIANMKPDSLQAPSLK | 25.04 | 772.73 | 806.94 | 31 |
| 9 | DMASWLIANMKPDSLQAPSLK | 25.04 | 772.73 | 863.48 | 31 |
| 10 | DMASWVIANMKPDSLQAPSLK | 24 | 768.06 | 806.94 | 30.9 |
| 11 | DMASWVIANMKPDSLQAPSLK | 24 | 768.06 | 856.47 | 30.9 |
| 12 | DMASWVIANMKPDSLQAPSLK | 24 | 768.06 | 949.51 | 30.9 |
| 13 | GEIALGDPVAK | 15.79 | 535.3 | 586.32 | 26.2 |
| 14 | GEIALGDPVAK | 15.77 | 535.3 | 699.4 | 26.2 |
| 15 | GEIALGDPVAK | 15.77 | 535.3 | 770.44 | 26.2 |
| 16 | TVVGGSDNK | 3.35 | 438.73 | 520.24 | 20.7 |
| 17 | TVVGGSDNK | 3.35 | 438.73 | 577.26 | 20.7 |
| 18 | TVVGGSDNK | 3.35 | 438.73 | 676.33 | 20.7 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 22

Identification of a Resistance to SHV Beta-Lactams

The samples corresponding to a species able to comprise an SHV resistance mechanism can be detected by employing the following method.

Each sample is treated according to example 5, then analysed according to example 6 by detecting the peptides from TABLE 28 instead of the peptides from TABLE 3.

TABLE 28

| Transition number | Peptide | Retention time (minutes) | (m/z) filtered in Q1 | (m/z) filtered in Q3 | Collision energy (eV) |
|---|---|---|---|---|---|
| 1 | EIGDNVTR | 10.07 | 452.23 | 489.28 | 25 |
| 2 | EIGDNVTR | 10.07 | 452.23 | 529.23 | 25 |
| 3 | EIGDNVTR | 10.07 | 452.23 | 661.33 | 25 |
| 4 | GIVALLGPHNK | 16.52 | 373.56 | 398.21 | 23 |
| 5 | GIVALLGPHNK | 16.52 | 373.56 | 552.29 | 23 |
| 6 | GIVALLGPHNK | 16.52 | 373.56 | 665.37 | 23 |
| 7 | HLADGMTVGELR | 14.93 | 433.56 | 474.27 | 26 |
| 8 | HLADGMTVGELR | 14.93 | 433.56 | 494.24 | 26 |
| 9 | HLADGMTVGELR | 14.93 | 433.56 | 573.34 | 26 |

TABLE 28-continued

| Transition number | Peptide | Retention time (minutes) | (m/z) filtered in Q1 | (m/z) filtered in Q3 | Collision energy (eV) |
|---|---|---|---|---|---|
| 10 | IHYSQQDLVDYSPVSEK | 16.22 | 669.99 | 872.39 | 37 |
| 11 | IHYSQQDLVDYSPVSEK | 16.22 | 669.99 | 924.43 | 37 |
| 12 | IHYSQQDLVDYSPVSEK | 16.22 | 669.99 | 985.47 | 37 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 23

Identification of a Resistance to CARB Beta-Lactams

The samples corresponding to a species able to comprise a CARB resistance mechanism can be detected by employing the following method.

Each sample is treated according to example 5, then analysed according to example 6 by detecting the peptides from TABLE 29 instead of the peptides from TABLE 3.

TABLE 29

| Transition number | Peptide | Retention time (minutes) | (m/z) filtered in Q1 | (m/z) filtered in Q3 | Collision energy (eV) |
|---|---|---|---|---|---|
| 1 | ADLVTYSPVIEK | 17.48 | 667.86 | 672.39 | 34.4 |
| 2 | ADLVTYSPVIEK | 17.48 | 667.86 | 835.46 | 34.4 |
| 3 | ADLVTYSPVIEK | 17.48 | 667.86 | 936.5 | 34.4 |
| 4 | ADLVTYSPVLEK | 18.01 | 667.86 | 672.39 | 34.4 |
| 5 | ADLVTYSPVLEK | 18.01 | 667.86 | 835.46 | 34.4 |
| 6 | ADLVTYSPVLEK | 18.01 | 667.86 | 936.5 | 34.4 |
| 7 | AIASTLNK | 10.86 | 409.24 | 475.29 | 23 |
| 8 | AIASTLNK | 10.86 | 409.24 | 562.32 | 23 |
| 9 | AIASTLNK | 10.86 | 409.24 | 633.36 | 23 |
| 10 | AIASTLNQLLFGSTLSEASQK | 25.39 | 727.06 | 362.2 | 40.4 |
| 11 | AIASTLNQLLFGSTLSEASQK | 25.39 | 727.06 | 649.32 | 40.4 |
| 12 | AIASTLNQLLFGSTLSEASQK | 25.39 | 727.06 | 998.02 | 40.4 |
| 13 | AIEVSLSAR | 15.46 | 473.27 | 533.3 | 25.8 |
| 14 | AIEVSLSAR | 15.46 | 473.27 | 632.37 | 25.8 |
| 15 | AIEVSLSAR | 15.46 | 473.27 | 761.42 | 25.8 |
| 16 | DTTTPIAMVTTLEK | 21.41 | 507.6 | 591.34 | 29.4 |
| 17 | DTTTPIAMVTTLEK | 21.41 | 507.6 | 690.4 | 29.4 |
| 18 | DTTTPIAMVTTLEK | 21.41 | 507.6 | 892.48 | 29.4 |
| 19 | DTTTPK | 1.54 | 331.67 | 345.21 | 19.6 |
| 20 | DTTTPK | 1.54 | 331.67 | 446.26 | 19.6 |
| 21 | DTTTPK | 1.54 | 331.67 | 547.31 | 19.6 |
| 22 | FLFGSALSEMNK | 21.32 | 672.34 | 879.42 | 34.6 |
| 23 | FLFGSALSEMNK | 21.32 | 672.34 | 936.45 | 34.6 |
| 24 | FLFGSALSEMNK | 21.32 | 672.34 | 1083.51 | 34.6 |

TABLE 29-continued

| Transition number | Peptide | Retention time (minutes) | (m/z) filtered in Q1 | (m/z) filtered in Q3 | Collision energy (eV) |
|---|---|---|---|---|---|
| 25 | FPLSSTFK | 17.51 | 463.75 | 390.22 | 25.4 |
| 26 | FPLSSTFK | 17.51 | 463.75 | 682.38 | 25.4 |
| 27 | FPLSSTFK | 17.51 | 463.75 | 779.43 | 25.4 |
| 28 | FPLTSTFK | 17.85 | 470.76 | 397.23 | 25.7 |
| 29 | FPLTSTFK | 17.85 | 470.76 | 696.39 | 25.7 |
| 30 | FPLTSTFK | 17.85 | 470.76 | 793.45 | 25.7 |
| 31 | FQQVEQDAK | 10.02 | 546.77 | 590.28 | 29.1 |
| 32 | FQQVEQDAK | 10.02 | 546.77 | 689.35 | 29.1 |
| 33 | FQQVEQDAK | 10.02 | 546.77 | 817.41 | 29.1 |
| 34 | FQQVEQDVK | 11.76 | 560.79 | 618.31 | 29.7 |
| 35 | FQQVEQDVK | 11.76 | 560.79 | 717.38 | 29.7 |
| 36 | FQQVEQDVK | 11.76 | 560.79 | 845.44 | 29.7 |
| 37 | FQSVEQEIK | 14.17 | 554.29 | 745.41 | 29.4 |
| 38 | FQSVEQEIK | 14.17 | 554.29 | 832.44 | 29.4 |
| 39 | FQSVEQEIK | 14.17 | 554.29 | 960.5 | 29.4 |
| 40 | FSESNLVTYSPVTEK | 17.84 | 567.62 | 462.74 | 32.4 |
| 41 | FSESNLVTYSPVTEK | 17.84 | 567.62 | 777.39 | 32.4 |
| 42 | FSESNLVTYSPVTEK | 17.85 | 567.62 | 924.47 | 32.4 |
| 43 | GIESSLSAR | 12.88 | 460.25 | 533.3 | 25.3 |
| 44 | GIESSLSAR | 12.88 | 460.25 | 620.34 | 25.3 |
| 45 | GIESSLSAR | 12.88 | 460.25 | 749.38 | 25.3 |
| 46 | GNEVGDALFR | 17.15 | 539.27 | 678.36 | 28.7 |
| 47 | GNEVGDALFR | 17.15 | 539.27 | 777.43 | 28.7 |
| 48 | GNEVGDALFR | 17.15 | 539.27 | 906.47 | 28.7 |
| 49 | GVPSDWIVADR | 18.32 | 607.81 | 529.77 | 31.7 |
| 50 | GVPSDWIVADR | 18.32 | 607.81 | 759.42 | 31.7 |
| 51 | GVPSDWIVADR | 18.32 | 607.81 | 1058.53 | 31.7 |
| 52 | GVTDFLR | 17.69 | 404.22 | 326.18 | 22.8 |
| 53 | GVTDFLR | 17.69 | 404.22 | 550.3 | 22.8 |
| 54 | GVTDFLR | 17.69 | 404.22 | 651.35 | 22.8 |
| 55 | IEPDLNEGK | 12.13 | 507.76 | 386.7 | 27.3 |
| 56 | IEPDLNEGK | 12.13 | 507.76 | 772.38 | 27.3 |
| 57 | IEPDLNEGK | 12.13 | 507.76 | 901.43 | 27.3 |
| 58 | IEPELNEGK | 12.2 | 514.77 | 393.7 | 27.6 |
| 59 | IEPELNEGK | 12.2 | 514.77 | 786.4 | 27.6 |
| 60 | IEPELNEGK | 12.2 | 514.77 | 915.44 | 27.6 |
| 61 | IGEQIAK | 10.58 | 379.72 | 459.29 | 21.7 |
| 62 | IGEQIAK | 10.58 | 379.72 | 588.34 | 21.7 |

TABLE 29-continued

| Transition number | Peptide | Retention time (minutes) | (m/z) filtered in Q1 | (m/z) filtered in Q3 | Collision energy (eV) |
|---|---|---|---|---|---|
| 63 | IGEQIAK | 10.58 | 379.72 | 645.36 | 21.7 |
| 64 | IGLAVHDLETGK | 16.05 | 626.85 | 799.39 | 32.6 |
| 65 | IGLAVHDLETGK | 16.05 | 626.85 | 898.46 | 32.6 |
| 66 | IGLAVHDLETGK | 16.05 | 626.85 | 969.5 | 32.6 |
| 67 | KPIVAALYITETDASFEER | 21.09 | 718.38 | 667.31 | 39.9 |
| 68 | KPIVAALYITETDASFEER | 21.09 | 718.38 | 787.37 | 39.9 |
| 69 | KPIVAALYITETDASFEER | 21.09 | 718.38 | 853.37 | 39.9 |
| 70 | LESWMVNNQVTGNLLR | 22.01 | 625.32 | 564.81 | 32.5 |
| 71 | LESWMVNNQVTGNLLR | 22.01 | 625.32 | 673.4 | 32.5 |
| 72 | LESWMVNNQVTGNLLR | 22.01 | 625.32 | 772.47 | 32.5 |
| 73 | LEYWMVNNQVTGNLLR | 22.96 | 650.67 | 564.81 | 33.6 |
| 74 | LEYWMVNNQVTGNLLR | 22.96 | 650.67 | 673.4 | 33.6 |
| 75 | LEYWMVNNQVTGNLLR | 22.96 | 650.67 | 772.47 | 33.6 |
| 76 | LLFGSALSEMNQK | 21.03 | 719.37 | 389.21 | 36.7 |
| 77 | LLFGSALSEMNQK | 21.03 | 719.37 | 736.33 | 36.7 |
| 78 | LLFGSALSEMNQK | 21.03 | 719.37 | 1211.57 | 36.7 |
| 79 | LLIDETLSIK | 20.7 | 572.85 | 805.43 | 30.2 |
| 80 | LLIDETLSIK | 20.7 | 572.85 | 918.51 | 30.2 |
| 81 | LLIDETLSIK | 20.7 | 572.85 | 1031.6 | 30.2 |
| 82 | LLYDAEHGK | 11.75 | 523.27 | 656.3 | 28 |
| 83 | LLYDAEHGK | 11.75 | 523.27 | 819.36 | 28 |
| 84 | LLYDAEHGK | 11.75 | 523.27 | 932.45 | 28 |
| 85 | LLYDAEQGEINPK | 15.72 | 745.38 | 358.21 | 37.8 |
| 86 | LLYDAEQGEINPK | 15.72 | 745.38 | 632.3 | 37.8 |
| 87 | LLYDAEQGEINPK | 15.72 | 745.38 | 785.42 | 37.8 |
| 88 | LLYDAEQGK | 13.05 | 518.77 | 647.3 | 27.8 |
| 89 | LLYDAEQGK | 13.05 | 518.77 | 810.36 | 27.8 |
| 90 | LLYDAEQGK | 13.05 | 518.77 | 923.45 | 27.8 |
| 91 | MCDNQNYGVTYMK | 14.67 | 541.89 | 641.33 | 31.1 |
| 92 | MCDNQNYGVTYMK | 14.67 | 541.89 | 698.35 | 31.1 |
| 93 | MCDNQNYGVTYMK | 14.67 | 541.89 | 861.42 | 31.1 |
| 94 | NAVIAK | 7.68 | 308.2 | 331.23 | 18.6 |
| 95 | NAVIAK | 7.68 | 308.2 | 430.3 | 18.6 |
| 96 | NAVIAK | 7.68 | 308.2 | 501.34 | 18.6 |
| 97 | NDAIVK | 8.38 | 330.19 | 359.27 | 19.5 |
| 98 | NDAIVK | 8.38 | 330.19 | 430.3 | 19.5 |
| 99 | NDAIVK | 8.38 | 330.19 | 545.33 | 19.5 |
| 100 | QQLESWLK | 17.65 | 516.28 | 533.31 | 27.7 |

TABLE 29-continued

| Transition number | Peptide | Retention time (minutes) | (m/z) filtered in Q1 | (m/z) filtered in Q3 | Collision energy (eV) |
|---|---|---|---|---|---|
| 101 | QQLESWLK | 17.65 | 516.28 | 662.35 | 27.7 |
| 102 | QQLESWLK | 17.65 | 516.28 | 775.44 | 27.7 |
| 103 | QVEQDVK | 6.63 | 423.22 | 361.21 | 23.6 |
| 104 | QVEQDVK | 6.63 | 423.22 | 489.27 | 23.6 |
| 105 | QVEQDVK | 6.63 | 423.22 | 618.31 | 23.6 |
| 106 | SGAGGFGAR | 9.32 | 390.19 | 507.27 | 22.2 |
| 107 | SGAGGFGAR | 9.32 | 390.19 | 564.29 | 22.2 |
| 108 | SGAGGFGAR | 9.32 | 390.19 | 635.33 | 22.2 |
| 109 | SIGDDTTR | 7.76 | 432.71 | 492.24 | 24 |
| 110 | SIGDDTTR | 7.76 | 432.71 | 607.27 | 24 |
| 111 | SIGDDTTR | 7.76 | 432.71 | 664.29 | 24 |
| 112 | SITAIVWSEEK | 18.92 | 631.84 | 405.2 | 32.8 |
| 113 | SITAIVWSEEK | 18.92 | 631.84 | 777.38 | 32.8 |
| 114 | SITAIVWSEEK | 18.92 | 631.84 | 1062.55 | 32.8 |
| 115 | SITDFLR | 19.34 | 426.24 | 435.27 | 23.8 |
| 116 | SITDFLR | 19.34 | 426.24 | 550.3 | 23.8 |
| 117 | SITDFLR | 19.34 | 426.24 | 651.35 | 23.8 |
| 118 | STIEIK | 11.83 | 345.71 | 389.24 | 20.2 |
| 119 | STIEIK | 11.83 | 345.71 | 502.32 | 20.2 |
| 120 | STIEIK | 11.83 | 345.71 | 603.37 | 20.2 |
| 121 | SVLPAGWNIADR | 19.61 | 649.85 | 500.25 | 33.6 |
| 122 | SVLPAGWNIADR | 19.61 | 649.85 | 556.8 | 33.6 |
| 123 | SVLPAGWNIADR | 19.61 | 649.85 | 999.5 | 33.6 |
| 124 | SVLPEGWNIADR | 19.62 | 678.85 | 529.26 | 34.9 |
| 125 | SVLPEGWNIADR | 19.62 | 678.85 | 585.8 | 34.9 |
| 126 | SVLPEGWNIADR | 19.62 | 678.85 | 1057.51 | 34.9 |
| 127 | SVLPVK | 13.24 | 321.71 | 343.23 | 19.2 |
| 128 | SVLPVK | 13.24 | 321.71 | 456.32 | 19.2 |
| 129 | SVLPVK | 13.24 | 321.71 | 555.39 | 19.2 |
| 130 | SVLPVTWSIADR | 21.34 | 672.37 | 522.78 | 34.6 |
| 131 | SVLPVTWSIADR | 21.34 | 672.37 | 1044.55 | 34.6 |
| 132 | SVLPVTWSIADR | 21.34 | 672.37 | 1157.63 | 34.6 |
| 133 | TGAGGYGSR | 3.77 | 413.2 | 596.28 | 23.2 |
| 134 | TGAGGYGSR | 3.77 | 413.2 | 667.32 | 23.2 |
| 135 | TGAGGYGSR | 3.77 | 413.2 | 724.34 | 23.2 |
| 136 | TIACAK | 3.86 | 332.18 | 378.18 | 19.6 |
| 137 | TIACAK | 3.86 | 332.18 | 449.22 | 19.6 |
| 138 | TIACAK | 3.86 | 332.18 | 562.3 | 19.6 |

TABLE 29-continued

| Transition number | Peptide | Retention time (minutes) | (m/z) filtered in Q1 | (m/z) filtered in Q3 | Collision energy (eV) |
|---|---|---|---|---|---|
| 139 | TILMENSR | 13.19 | 482.25 | 505.24 | 26.2 |
| 140 | TILMENSR | 13.19 | 482.25 | 636.28 | 26.2 |
| 141 | TILMENSR | 13.19 | 482.25 | 749.36 | 26.2 |
| 142 | TLACANVLQR | 14.83 | 573.31 | 466.24 | 30.2 |
| 143 | TLACANVLQR | 14.83 | 573.31 | 860.44 | 30.2 |
| 144 | TLACANVLQR | 14.83 | 573.31 | 931.48 | 30.2 |
| 145 | TVLMENSR | 11.76 | 475.24 | 505.24 | 25.9 |
| 146 | TVLMENSR | 11.76 | 475.24 | 636.28 | 25.9 |
| 147 | TVLMENSR | 11.76 | 475.24 | 749.36 | 25.9 |
| 148 | VEPELNEGK | 11.18 | 507.76 | 393.7 | 27.3 |
| 149 | VEPELNEGK | 11.18 | 507.76 | 447.22 | 27.3 |
| 150 | VEPELNEGK | 11.18 | 507.76 | 560.3 | 27.3 |
| 151 | VNLNSTVEIK | 15.48 | 558.82 | 790.43 | 29.6 |
| 152 | VNLNSTVEIK | 15.48 | 558.82 | 903.52 | 29.6 |
| 153 | VNLNSTVEIK | 15.48 | 558.82 | 1017.56 | 29.6 |
| 154 | VNLNSTVEVK | 14.23 | 551.81 | 776.42 | 29.3 |
| 155 | VNLNSTVEVK | 14.23 | 551.81 | 889.5 | 29.3 |
| 156 | VNLNSTVEVK | 14.23 | 551.81 | 1003.54 | 29.3 |
| 157 | VNPNSTVEIK | 12.41 | 550.8 | 444.25 | 29.2 |
| 158 | VNPNSTVEIK | 12.41 | 550.8 | 887.48 | 29.2 |
| 159 | VNPNSTVEIK | 12.41 | 550.8 | 1001.53 | 29.2 |
| 160 | VNSNSTVEIK | 11.24 | 545.79 | 790.43 | 29 |
| 161 | VNSNSTVEIK | 11.24 | 545.79 | 877.46 | 29 |
| 162 | VNSNSTVEIK | 11.24 | 545.79 | 991.51 | 29 |
| 163 | WETELNEAVPGDK | 16.5 | 744.35 | 358.19 | 37.8 |
| 164 | WETELNEAVPGDK | 16.5 | 744.35 | 415.21 | 37.8 |
| 165 | WETELNEAVPGDK | 16.5 | 744.35 | 471.75 | 37.8 |
| 166 | WSIADR | 14.14 | 374.19 | 361.18 | 21.5 |
| 167 | WSIADR | 14.14 | 374.19 | 474.27 | 21.5 |
| 168 | WSIADR | 14.14 | 374.19 | 561.3 | 21.5 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 24

Identification of a Resistance to OXA Beta-Lactams

The samples corresponding to a species able to comprise an OXA resistance mechanism can be detected by employing the following method.

Each sample is treated according to example 5, then analysed according to example 6 by detecting the peptides from TABLE 30 instead of the peptides from TABLE 3.

TABLE 30

| Transition number | Peptide | Retention time (minutes) | (m/z) filtered in Q1 | (m/z) filtered in Q3 | Collision energy (eV) |
|---|---|---|---|---|---|
| 1 | AAAYELAENLFEAGQADGWR | 24.48 | 728.01 | 1249.6 | 40 |
| 2 | AAAYELAENLFEAGQADGWR | 24.48 | 1091.51 | 1193.58 | 53 |
| 3 | AAAYELAENLFEAGQADGWR | 24.48 | 1091.51 | 1249.6 | 53 |
| 4 | AAEGFIPASTFK | 17.74 | 619.82 | 763.43 | 32 |
| 5 | AAEGFIPASTFK | 17.74 | 619.82 | 910.5 | 32 |
| 6 | AAEGFIPASTFK | 17.74 | 619.82 | 967.52 | 32 |
| 7 | ADGQVVAFALNMQMK | 21.27 | 811.91 | 982.48 | 41 |
| 8 | ADGQVVAFALNMQMK | 21.29 | 811.91 | 1053.52 | 41 |
| 9 | ADGQVVAFALNMQMK | 21.27 | 811.91 | 1152.59 | 41 |
| 10 | ADINEIFK | 17.3 | 475.25 | 650.35 | 26 |
| 11 | ADINEIFK | 17.3 | 475.25 | 763.43 | 26 |
| 12 | ADINEIFK | 17.3 | 475.25 | 878.46 | 26 |
| 13 | ADWGK | 6.9 | 288.64 | 390.21 | 18 |
| 14 | ADWGK | 6.91 | 288.64 | 430.17 | 18 |
| 15 | ADWGK | 6.89 | 288.64 | 505.24 | 18 |
| 16 | AEGAIVISDER | 13.52 | 387.2 | 419.19 | 23 |
| 17 | AEGAIVISDER | 13.53 | 387.2 | 506.22 | 23 |
| 18 | AEGAIVISDER | 13.52 | 387.2 | 619.3 | 23 |
| 19 | AFALNLDIDK | 20.16 | 560.31 | 717.38 | 30 |
| 20 | AFALNLDIDK | 20.16 | 560.31 | 830.46 | 30 |
| 21 | AFALNLDIDK | 20.16 | 560.31 | 901.5 | 30 |
| 22 | AFAPMSTFK | 16.96 | 500.25 | 710.35 | 27 |
| 23 | AFAPMSTFK | 16.96 | 500.25 | 781.39 | 27 |
| 24 | AFAPMSTFK | 16.96 | 500.25 | 928.46 | 27 |
| 25 | AFGYGNADVSGDPGQNNGLDR | 15.12 | 708.65 | 873.42 | 39 |
| 26 | AFGYGNADVSGDPGQNNGLDR | 15.12 | 708.65 | 970.47 | 39 |
| 27 | AFGYGNADVSGDPGQNNGLDR | 15.12 | 708.65 | 1154.47 | 39 |
| 28 | AFTMTK | 11.32 | 349.68 | 480.25 | 20 |
| 29 | AFTMTK | 11.33 | 349.68 | 552.25 | 20 |
| 30 | AFTMTK | 11.33 | 349.68 | 627.32 | 20 |
| 31 | AGDDIALR | 12.23 | 415.72 | 587.35 | 23 |
| 32 | AGDDIALR | 12.23 | 415.72 | 702.38 | 23 |
| 33 | AGDDIALR | 12.23 | 415.72 | 759.4 | 23 |
| 34 | AGHVYAFALNIDMPR | 20.63 | 558.95 | 631.32 | 32 |
| 35 | AGHVYAFALNIDMPR | 20.63 | 558.95 | 745.37 | 32 |
| 36 | AGHVYAFALNIDMPR | 20.63 | 558.95 | 817.4 | 32 |
| 37 | AGLWR | 13.44 | 301.67 | 361.2 | 18 |
| 38 | AGLWR | 13.44 | 301.67 | 474.28 | 18 |

TABLE 30-continued

| Transition number | Peptide | Retention time (minutes) | (m/z) filtered in Q1 | (m/z) filtered in Q3 | Collision energy (eV) |
|---|---|---|---|---|---|
| 39 | AGLWR | 13.44 | 301.67 | 531.3 | 18 |
| 40 | AHTEYVPASTFK | 13.18 | 450.89 | 553.3 | 27 |
| 41 | AHTEYVPASTFK | 13.18 | 450.89 | 602.26 | 27 |
| 42 | AHTEYVPASTFK | 13.18 | 450.89 | 650.35 | 27 |
| 43 | AIIPWDGKPR | 15.84 | 384.89 | 428.23 | 23 |
| 44 | AIIPWDGKPR | 15.84 | 384.89 | 457.29 | 23 |
| 45 | AIIPWDGKPR | 15.84 | 384.89 | 572.32 | 23 |
| 46 | AISDITITR | 14.8 | 495.28 | 603.38 | 27 |
| 47 | AISDITITR | 14.8 | 495.28 | 718.41 | 27 |
| 48 | AISDITITR | 14.8 | 495.28 | 805.44 | 27 |
| 49 | ALGQDR | 11.25 | 330.18 | 475.23 | 20 |
| 50 | ALGQDR | 11.25 | 330.18 | 485.24 | 20 |
| 51 | ALGQDR | 11.25 | 330.18 | 588.31 | 20 |
| 52 | ALQAK | 1.86 | 265.67 | 346.21 | 17 |
| 53 | ALQAK | 1.87 | 265.67 | 384.22 | 17 |
| 54 | ALQAK | 1.87 | 265.67 | 459.29 | 17 |
| 55 | AMETFSPASTFK | 17.06 | 658.81 | 737.38 | 34 |
| 56 | AMETFSPASTFK | 17.05 | 658.81 | 985.5 | 34 |
| 57 | AMETFSPASTFK | 17.06 | 658.81 | 1114.54 | 34 |
| 58 | AMLFLQER | 18.48 | 504.27 | 545.3 | 27 |
| 59 | AMLFLQER | 18.48 | 504.27 | 692.37 | 27 |
| 60 | AMLFLQER | 18.48 | 504.27 | 805.46 | 27 |
| 61 | AMLVFDPVR | 19.87 | 524.29 | 732.4 | 28 |
| 62 | AMLVFDPVR | 19.87 | 524.29 | 845.49 | 28 |
| 63 | AMLVFDPVR | 19.87 | 524.29 | 976.53 | 28 |
| 64 | AMTLLESGPGWELHGK | 19.32 | 575.96 | 923.47 | 33 |
| 65 | AMTLLESGPGWELHGK | 19.32 | 575.96 | 980.49 | 33 |
| 66 | AMTLLESGPGWELHGK | 19.32 | 575.96 | 1067.53 | 33 |
| 67 | ANLHITLHGK | 12.18 | 368.55 | 403.24 | 22 |
| 68 | ANLHITLHGK | 12.18 | 368.55 | 555.32 | 22 |
| 69 | ANLHITLHGK | 12.18 | 368.55 | 668.41 | 22 |
| 70 | ANQLIVK | 11.87 | 393.25 | 600.41 | 22 |
| 71 | ANQLIVK | 11.86 | 393.25 | 639.38 | 22 |
| 72 | ANQLIVK | 11.86 | 393.25 | 714.45 | 22 |
| 73 | ANTEYVPASTFK | 14.54 | 664.33 | 912.48 | 34 |
| 74 | ANTEYVPASTFK | 14.54 | 664.33 | 1041.53 | 34 |
| 75 | ANTEYVPASTFK | 14.54 | 664.33 | 1142.57 | 34 |
| 76 | ANVSR | 9.57 | 273.65 | 361.22 | 17 |

TABLE 30-continued

| Transition number | Peptide | Retention time (minutes) | (m/z) filtered in Q1 | (m/z) filtered in Q3 | Collision energy (eV) |
|---|---|---|---|---|---|
| 77 | ANVSR | 9.57 | 273.65 | 372.19 | 17 |
| 78 | ANVSR | 9.57 | 273.65 | 475.26 | 17 |
| 79 | APIGWFIGWATR | 25.58 | 687.87 | 850.46 | 35 |
| 80 | APIGWFIGWATR | 25.58 | 687.87 | 1093.56 | 35 |
| 81 | APIGWFIGWATR | 25.58 | 687.87 | 1206.64 | 35 |
| 82 | APLGWFIGWATHEER | 24.69 | 590.63 | 742.35 | 34 |
| 83 | APLGWFIGWATHEER | 24.69 | 590.63 | 985.45 | 34 |
| 84 | APLGWFIGWATHEER | 24.69 | 590.63 | 1098.53 | 34 |
| 85 | AQDEVQSMLFIEEK | 20.15 | 833.9 | 996.51 | 42 |
| 86 | AQDEVQSMLFIEEK | 20.14 | 833.9 | 1124.57 | 42 |
| 87 | AQDEVQSMLFIEEK | 20.15 | 833.9 | 1223.63 | 42 |
| 88 | AQGVIVLWNENK | 18.95 | 685.87 | 902.47 | 35 |
| 89 | AQGVIVLWNENK | 18.95 | 685.87 | 1015.56 | 35 |
| 90 | AQGVIVLWNENK | 18.95 | 685.87 | 1171.65 | 35 |
| 91 | ASAIAVYQDLAR | 18.05 | 639.35 | 765.39 | 33 |
| 92 | ASAIAVYQDLAR | 18.05 | 639.35 | 864.46 | 33 |
| 93 | ASAIAVYQDLAR | 18.05 | 639.35 | 935.49 | 33 |
| 94 | ASAILVYQDLAR | 19.08 | 660.37 | 765.39 | 34 |
| 95 | ASAILVYQDLAR | 19.08 | 660.37 | 864.46 | 34 |
| 96 | ASAILVYQDLAR | 19.08 | 660.37 | 977.54 | 34 |
| 97 | ASAIPVYQDLAR | 17.45 | 652.35 | 765.39 | 34 |
| 98 | ASAIPVYQDLAR | 17.45 | 652.35 | 864.46 | 34 |
| 99 | ASAIPVYQDLAR | 17.45 | 652.35 | 961.51 | 34 |
| 100 | ASAIPVYQDLPR | 17.59 | 665.36 | 791.4 | 34 |
| 101 | ASAIPVYQDLPR | 17.59 | 665.36 | 890.47 | 34 |
| 102 | ASAIPVYQDLPR | 17.6 | 665.36 | 987.53 | 34 |
| 103 | ASAIQVYQDLAR | 18.37 | 667.86 | 765.39 | 34 |
| 104 | ASAIQVYQDLAR | 18.37 | 667.86 | 864.46 | 34 |
| 105 | ASAIQVYQDLAR | 18.37 | 667.86 | 992.52 | 34 |
| 106 | ASAISVYQDLAR | 17.93 | 647.34 | 765.39 | 33 |
| 107 | ASAISVYQDLAR | 17.93 | 647.34 | 864.46 | 33 |
| 108 | ASAISVYQDLAR | 17.93 | 647.34 | 951.49 | 33 |
| 109 | ASALPVYQDLAR | 17.77 | 652.35 | 864.46 | 34 |
| 110 | ASALPVYQDLAR | 17.77 | 652.35 | 961.51 | 34 |
| 111 | ASALPVYQDLAR | 17.77 | 652.35 | 1074.59 | 34 |
| 112 | ASAMPVYQDLAR | 16.64 | 661.33 | 765.39 | 34 |
| 113 | ASAMPVYQDLAR | 16.64 | 661.33 | 864.46 | 34 |
| 114 | ASAMPVYQDLAR | 16.64 | 661.33 | 961.51 | 34 |

TABLE 30-continued

| Transition number | Peptide | Retention time (minutes) | (m/z) filtered in Q1 | (m/z) filtered in Q3 | Collision energy (eV) |
|---|---|---|---|---|---|
| 115 | ASAVPVYQDLAR | 16.29 | 645.35 | 765.39 | 33 |
| 116 | ASAVPVYQDLAR | 16.29 | 645.35 | 864.46 | 33 |
| 117 | ASAVPVYQDLAR | 16.29 | 645.35 | 961.51 | 33 |
| 118 | ASIEYVPASTFK | 16.7 | 656.84 | 749.42 | 34 |
| 119 | ASIEYVPASTFK | 16.7 | 656.84 | 912.48 | 34 |
| 120 | ASIEYVPASTFK | 16.7 | 656.84 | 1041.53 | 34 |
| 121 | ASNVPVYQELAR | 18.48 | 673.86 | 779.4 | 35 |
| 122 | ASNVPVYQELAR | 18.48 | 673.86 | 878.47 | 35 |
| 123 | ASNVPVYQELAR | 18.48 | 673.86 | 975.53 | 35 |
| 124 | ASPASTFK | 10.29 | 404.71 | 553.3 | 23 |
| 125 | ASPASTFK | 10.29 | 404.71 | 650.35 | 23 |
| 126 | ASPASTFK | 10.28 | 404.71 | 737.38 | 23 |
| 127 | ASTAYIPASTFK | 15.69 | 628.83 | 763.43 | 33 |
| 128 | ASTAYIPASTFK | 15.69 | 628.83 | 926.5 | 33 |
| 129 | ASTAYIPASTFK | 15.69 | 628.83 | 997.54 | 33 |
| 130 | ASTEYVPASTFK | 14.59 | 650.82 | 749.42 | 34 |
| 131 | ASTEYVPASTFK | 14.59 | 650.82 | 912.48 | 34 |
| 132 | ASTEYVPASTFK | 14.6 | 650.82 | 1041.53 | 34 |
| 133 | ASTTEVFK | 11.78 | 441.73 | 623.34 | 24 |
| 134 | ASTTEVFK | 11.78 | 441.73 | 724.39 | 24 |
| 135 | ASTTEVFK | 11.78 | 441.73 | 811.42 | 24 |
| 136 | ATSTEIFK | 13.15 | 448.74 | 637.36 | 25 |
| 137 | ATSTEIFK | 13.15 | 448.74 | 724.39 | 25 |
| 138 | ATSTEIFK | 13.15 | 448.74 | 825.44 | 25 |
| 139 | ATTNEIFK | 13.21 | 462.25 | 650.35 | 25 |
| 140 | ATTNEIFK | 13.21 | 462.25 | 751.4 | 25 |
| 141 | ATTNEIFK | 13.21 | 462.25 | 852.45 | 25 |
| 142 | ATTTAVFK | 11.9 | 419.74 | 464.29 | 23 |
| 143 | ATTTAVFK | 11.9 | 419.74 | 565.33 | 23 |
| 144 | ATTTAVFK | 11.9 | 419.74 | 666.38 | 23 |
| 145 | ATTTEIFK | 13.64 | 455.75 | 637.36 | 25 |
| 146 | ATTTEIFK | 13.65 | 455.75 | 738.4 | 25 |
| 147 | ATTTEIFK | 13.65 | 455.75 | 839.45 | 25 |
| 148 | ATTTEVFK | 11.98 | 448.74 | 623.34 | 25 |
| 149 | ATTTEVFK | 11.98 | 448.74 | 724.39 | 25 |
| 150 | ATTTEVFK | 11.98 | 448.74 | 825.44 | 25 |
| 151 | AVSDITILEQTDNYTLHGK | 19.19 | 706.7 | 974.49 | 39 |
| 152 | AVSDITILEQTDNYTLHGK | 19.19 | 706.7 | 1048.51 | 39 |

TABLE 30-continued

| Transition number | Peptide | Retention time (minutes) | (m/z) filtered in Q1 | (m/z) filtered in Q3 | Collision energy (eV) |
|---|---|---|---|---|---|
| 153 | AVSDITILEQTDNYTLHGK | 19.18 | 706.7 | 1176.56 | 39 |
| 154 | AVSDITILEQTYNYTLHGK | 22.29 | 722.71 | 995.49 | 40 |
| 155 | AVSDITILEQTYNYTLHGK | 22.29 | 722.71 | 998.5 | 40 |
| 156 | AVSDITILEQTYNYTLHGK | 22.28 | 722.71 | 1224.6 | 40 |
| 157 | AVVPHFEAGDWDVQGK | 17.81 | 585.62 | 743.34 | 33 |
| 158 | AVVPHFEAGDWDVQGK | 17.81 | 585.62 | 792.88 | 33 |
| 159 | AVVPHFEAGDWDVQGK | 17.81 | 585.62 | 904.42 | 33 |
| 160 | AWEHDMSLR | 13.99 | 572.76 | 758.36 | 30 |
| 161 | AWEHDMSLR | 13.99 | 572.76 | 887.4 | 30 |
| 162 | AWEHDMSLR | 13.99 | 572.76 | 1073.48 | 30 |
| 163 | AWIGSSLQISPLEQLEFLGK | 26.98 | 739.4 | 963.51 | 41 |
| 164 | AWIGSSLQISPLEQLEFLGK | 26.99 | 739.4 | 1173.65 | 41 |
| 165 | AWIGSSLQISPLEQLEFLGK | 26.98 | 1108.6 | 1173.65 | 54 |
| 166 | DAFLK | 12.42 | 297.17 | 407.27 | 18 |
| 167 | DAFLK | 12.43 | 297.17 | 447.22 | 18 |
| 168 | DAFLK | 12.42 | 297.17 | 478.3 | 18 |
| 169 | DDFILHGK | 13.99 | 472.75 | 714.43 | 26 |
| 170 | DDFILHGK | 13.99 | 472.75 | 798.38 | 26 |
| 171 | DDFILHGK | 13.99 | 472.75 | 829.46 | 26 |
| 172 | DDVLK | 8.62 | 295.16 | 359.27 | 18 |
| 173 | DDVLK | 8.63 | 295.16 | 443.21 | 18 |
| 174 | DDVLK | 8.62 | 295.16 | 474.29 | 18 |
| 175 | DEFHVFR | 15.39 | 475.23 | 705.38 | 26 |
| 176 | DEFHVFR | 15.39 | 475.23 | 775.34 | 26 |
| 177 | DEFHVFR | 15.39 | 475.23 | 834.43 | 26 |
| 178 | DEFQIFR | 19.02 | 477.74 | 520.2 | 26 |
| 179 | DEFQIFR | 19.02 | 477.74 | 563.33 | 26 |
| 180 | DEFQIFR | 19.02 | 477.74 | 710.4 | 26 |
| 181 | DEFQVFR | 17.29 | 470.73 | 549.31 | 26 |
| 182 | DEFQVFR | 17.28 | 470.73 | 619.27 | 26 |
| 183 | DEFQVFR | 17.29 | 470.73 | 696.38 | 26 |
| 184 | DELVR | 9.33 | 316.17 | 387.27 | 19 |
| 185 | DELVR | 9.35 | 316.17 | 457.23 | 19 |
| 186 | DELVR | 9.33 | 316.17 | 516.31 | 19 |
| 187 | DFDYGNQDFSGDK | 14.72 | 754.3 | 967.41 | 38 |
| 188 | DFDYGNQDFSGDK | 14.72 | 754.3 | 1130.47 | 38 |
| 189 | DFDYGNQDFSGDK | 14.72 | 754.3 | 1245.5 | 38 |
| 190 | DFTLGEAMQASTVPVYQELAR | 24.19 | 776.05 | 975.53 | 43 |

TABLE 30-continued

| Transition number | Peptide | Retention time (minutes) | (m/z) filtered in Q1 | (m/z) filtered in Q3 | Collision energy (eV) |
|---|---|---|---|---|---|
| 191 | DFTLGEAMQASTVPVYQELAR | 24.19 | 776.05 | 1074.59 | 43 |
| 192 | DFTLGEAMQASTVPVYQELAR | 24.19 | 1163.57 | 1175.64 | 56 |
| 193 | DHDLITAMK | 14.23 | 522.26 | 563.32 | 28 |
| 194 | DHDLITAMK | 14.23 | 522.26 | 695.34 | 28 |
| 195 | DHDLITAMK | 14.23 | 522.26 | 791.43 | 28 |
| 196 | DIAAWNR | 13.63 | 423.22 | 546.28 | 24 |
| 197 | DIAAWNR | 13.63 | 423.22 | 617.32 | 24 |
| 198 | DIAAWNR | 13.62 | 423.22 | 730.4 | 24 |
| 199 | DILYIQELAGGWK | 24.49 | 753.4 | 888.46 | 38 |
| 200 | DILYIQELAGGWK | 24.48 | 753.4 | 1001.54 | 38 |
| 201 | DILYIQELAGGWK | 24.49 | 753.4 | 1164.6 | 38 |
| 202 | DITILEK | 15.9 | 416.24 | 603.37 | 23 |
| 203 | DITILEK | 15.91 | 416.24 | 685.38 | 23 |
| 204 | DITILEK | 15.91 | 416.24 | 716.46 | 23 |
| 205 | DLLSAK | 12.45 | 323.69 | 429.23 | 19 |
| 206 | DLLSAK | 12.44 | 323.69 | 500.27 | 19 |
| 207 | DLLSAK | 12.45 | 323.69 | 531.35 | 19 |
| 208 | DLMITEAGR | 15.07 | 503.26 | 533.27 | 27 |
| 209 | DLMITEAGR | 15.07 | 503.26 | 646.35 | 27 |
| 210 | DLMITEAGR | 15.07 | 503.26 | 777.39 | 27 |
| 211 | DLMIVEAGR | 16.68 | 502.27 | 531.29 | 27 |
| 212 | DLMIVEAGR | 16.68 | 502.27 | 644.37 | 27 |
| 213 | DLMIVEAGR | 16.68 | 502.27 | 775.41 | 27 |
| 214 | DLMIVEAK | 16.23 | 459.75 | 473.24 | 25 |
| 215 | DLMIVEAK | 16.23 | 459.75 | 559.34 | 25 |
| 216 | DLMIVEAK | 16.23 | 459.75 | 690.39 | 25 |
| 217 | DLSGNPGK | 6.69 | 394.2 | 472.25 | 22 |
| 218 | DLSGNPGK | 6.69 | 394.2 | 559.28 | 22 |
| 219 | DLSGNPGK | 6.7 | 394.2 | 672.37 | 22 |
| 220 | DLSLR | 12.37 | 302.18 | 375.24 | 18 |
| 221 | DLSLR | 12.35 | 302.18 | 429.23 | 18 |
| 222 | DLSLR | 12.36 | 302.18 | 488.32 | 18 |
| 223 | DLTLR | 12.48 | 309.18 | 389.25 | 19 |
| 224 | DLTLR | 12.47 | 309.18 | 443.25 | 19 |
| 225 | DLTLR | 12.47 | 309.18 | 502.33 | 19 |
| 226 | DMTLGDAIK | 15.97 | 482.24 | 503.28 | 26 |
| 227 | DMTLGDAIK | 15.97 | 482.24 | 616.37 | 26 |
| 228 | DMTLGDAIK | 15.97 | 482.24 | 717.41 | 26 |

TABLE 30-continued

| Transition number | Peptide | Retention time (minutes) | (m/z) filtered in Q1 | (m/z) filtered in Q3 | Collision energy (eV) |
|---|---|---|---|---|---|
| 229 | DMTLGDAMALSAVPVYQELAR | 25.76 | 751.04 | 975.53 | 42 |
| 230 | DMTLGDAMALSAVPVYQELAR | 25.76 | 1126.06 | 1145.63 | 55 |
| 231 | DMTLGDAMALSAVPVYQELAR | 25.75 | 1126.06 | 1232.66 | 55 |
| 232 | DMTLGDAMK | 14.46 | 491.22 | 634.32 | 27 |
| 233 | DMTLGDAMK | 14.46 | 491.22 | 735.37 | 27 |
| 234 | DMTLGDAMK | 14.46 | 491.22 | 866.41 | 27 |
| 235 | DMTLGEAMALSAVPVYQDLAR | 25.92 | 751.04 | 961.51 | 42 |
| 236 | DMTLGEAMALSAVPVYQDLAR | 25.92 | 1126.06 | 1131.62 | 55 |
| 237 | DMTLGEAMALSAVPVYQDLAR | 25.92 | 1126.06 | 1218.65 | 55 |
| 238 | DMTLGEAMALSAVPVYQELAR | 26.48 | 755.71 | 779.4 | 42 |
| 239 | DMTLGEAMALSAVPVYQELAR | 26.48 | 755.71 | 975.53 | 42 |
| 240 | DMTLGEAMALSAVPVYQELAR | 26.47 | 1133.07 | 1232.66 | 55 |
| 241 | DMTLGEAMK | 15.09 | 498.23 | 535.25 | 27 |
| 242 | DMTLGEAMK | 15.09 | 498.23 | 648.34 | 27 |
| 243 | DMTLGEAMK | 15.09 | 498.23 | 749.39 | 27 |
| 244 | DMTLGQAMQASAVPVYQELAR | 23.29 | 760.38 | 779.4 | 42 |
| 245 | DMTLGQAMQASAVPVYQELAR | 23.29 | 760.38 | 975.53 | 42 |
| 246 | DMTLGQAMQASAVPVYQELAR | 23.29 | 760.38 | 976.42 | 42 |
| 247 | DQDLR | 2.54 | 323.66 | 403.23 | 19 |
| 248 | DQDLR | 2.55 | 323.66 | 472.2 | 19 |
| 249 | DQDLR | 2.55 | 323.66 | 531.29 | 19 |
| 250 | DQQIGWFVGWASKPGK | 21.64 | 601.98 | 830.45 | 34 |
| 251 | DQQIGWFVGWASKPGK | 21.64 | 902.46 | 929.52 | 45 |
| 252 | DQQIGWFVGWASKPGK | 21.64 | 902.46 | 1076.59 | 45 |
| 253 | DQQVQVYGNDLNR | 13.59 | 774.87 | 851.4 | 39 |
| 254 | DQQVQVYGNDLNR | 13.58 | 774.87 | 950.47 | 39 |
| 255 | DQQVQVYGNDLNR | 13.59 | 774.87 | 1078.53 | 39 |
| 256 | DQTLESAFK | 15.21 | 519.76 | 581.29 | 28 |
| 257 | DQTLESAFK | 15.21 | 519.76 | 694.38 | 28 |
| 258 | DQTLESAFK | 15.21 | 519.76 | 795.42 | 28 |
| 259 | DSIVWYSQELTR | 19.61 | 748.87 | 896.45 | 38 |
| 260 | DSIVWYSQELTR | 19.61 | 748.87 | 1082.53 | 38 |
| 261 | DSIVWYSQELTR | 19.61 | 748.87 | 1181.59 | 38 |
| 262 | DSIVWYSQQLTR | 19.1 | 748.38 | 895.46 | 38 |
| 263 | DSIVWYSQQLTR | 19.11 | 748.38 | 1081.54 | 38 |
| 264 | DSIVWYSQQLTR | 19.1 | 748.38 | 1180.61 | 38 |
| 265 | DSNLR | 1.77 | 302.66 | 402.25 | 18 |
| 266 | DSNLR | 1.77 | 302.66 | 430.19 | 18 |

TABLE 30-continued

| Transition number | Peptide | Retention time (minutes) | (m/z) filtered in Q1 | (m/z) filtered in Q3 | Collision energy (eV) |
|---|---|---|---|---|---|
| 267 | DSNLR | 1.77 | 302.66 | 489.28 | 18 |
| 268 | DSYIAWGGEAWK | 19.67 | 691.82 | 833.39 | 35 |
| 269 | DSYIAWGGEAWK | 19.67 | 691.82 | 904.43 | 35 |
| 270 | DSYIAWGGEAWK | 19.66 | 691.82 | 1017.52 | 35 |
| 271 | DTLNPEWPYK | 17.3 | 631.81 | 819.4 | 33 |
| 272 | DTLNPEWPYK | 17.3 | 631.81 | 933.45 | 33 |
| 273 | DTLNPEWPYK | 17.3 | 631.81 | 1046.53 | 33 |
| 274 | DVDEVFYK | 15.62 | 507.74 | 685.36 | 27 |
| 275 | DVDEVFYK | 15.62 | 507.74 | 800.38 | 27 |
| 276 | DVDEVFYK | 15.62 | 507.74 | 899.45 | 27 |
| 277 | DWILR | 17.44 | 351.7 | 415.2 | 20 |
| 278 | DWILR | 17.44 | 351.7 | 528.28 | 20 |
| 279 | DWILR | 17.44 | 351.7 | 587.37 | 20 |
| 280 | EAFLR | 12.51 | 318.18 | 435.27 | 19 |
| 281 | EAFLR | 12.51 | 318.18 | 461.24 | 19 |
| 282 | EAFLR | 12.51 | 318.18 | 506.31 | 19 |
| 283 | EAIVR | 7.84 | 294.18 | 387.27 | 18 |
| 284 | EAIVR | 7.84 | 294.18 | 413.24 | 18 |
| 285 | EAIVR | 7.84 | 294.18 | 458.31 | 18 |
| 286 | EAIVTEATPEYIVHSK | 16.43 | 596.31 | 746.42 | 34 |
| 287 | EAIVTEATPEYIVHSK | 16.43 | 596.31 | 972.51 | 34 |
| 288 | EAIVTEATPEYIVHSK | 16.42 | 596.31 | 1073.56 | 34 |
| 289 | EALVTEAAPEYLVHSK | 17.3 | 586.31 | 875.46 | 33 |
| 290 | EALVTEAAPEYLVHSK | 17.3 | 586.31 | 972.51 | 33 |
| 291 | EALVTEAAPEYLVHSK | 17.3 | 586.31 | 1114.59 | 33 |
| 292 | EALVTEAPEYLVHSK | 17.58 | 562.63 | 637.32 | 32 |
| 293 | EALVTEAPEYLVHSK | 17.58 | 562.63 | 972.51 | 32 |
| 294 | EALVTEAPEYLVHSK | 17.58 | 562.63 | 1043.55 | 32 |
| 295 | EEIVR | 8.41 | 323.18 | 387.27 | 19 |
| 296 | EEIVR | 8.4 | 323.18 | 471.24 | 19 |
| 297 | EEIVR | 8.4 | 323.18 | 516.31 | 19 |
| 298 | EEVLAALPAQLK | 19.48 | 641.37 | 740.47 | 33 |
| 299 | EEVLAALPAQLK | 19.47 | 641.37 | 811.5 | 33 |
| 300 | EEVLAALPAQLK | 19.47 | 641.37 | 924.59 | 33 |
| 301 | EFSAEAVNGVFVLC[CAM]K | 21.1 | 835.42 | 936.5 | 42 |
| 302 | EFSAEAVNGVFVLC[CAM]K | 21.1 | 835.42 | 1106.6 | 42 |
| 303 | EFSAEAVNGVFVLC[CAM]K | 21.1 | 835.42 | 1235.65 | 42 |
| 304 | EFSSESVHGVFVLC[CAM]K | 18.26 | 575.62 | 666.36 | 33 |

TABLE 30-continued

| Transition number | Peptide | Retention time (minutes) | (m/z) filtered in Q1 | (m/z) filtered in Q3 | Collision energy (eV) |
|---|---|---|---|---|---|
| 305 | EFSSESVHGVFVLC[CAM]K | 18.26 | 575.62 | 822.45 | 33 |
| 306 | EFSSESVHGVFVLC[CAM]K | 18.26 | 575.62 | 959.51 | 33 |
| 307 | EGMSGSIR | 9.88 | 418.7 | 432.26 | 23 |
| 308 | EGMSGSIR | 9.88 | 418.7 | 519.29 | 23 |
| 309 | EGMSGSIR | 9.88 | 418.7 | 707.35 | 23 |
| 310 | EGMTGSIR | 10.63 | 425.71 | 432.26 | 24 |
| 311 | EGMTGSIR | 10.63 | 425.71 | 533.3 | 24 |
| 312 | EGMTGSIR | 10.63 | 425.71 | 664.34 | 24 |
| 313 | EIAVWNR | 14.78 | 444.24 | 475.24 | 25 |
| 314 | EIAVWNR | 14.77 | 444.24 | 574.31 | 25 |
| 315 | EIAVWNR | 14.77 | 444.24 | 645.35 | 25 |
| 316 | EIAYK | 8.46 | 312.17 | 381.21 | 19 |
| 317 | EIAYK | 8.46 | 312.17 | 477.23 | 19 |
| 318 | EIAYK | 8.46 | 312.17 | 494.3 | 19 |
| 319 | EIFER | 11.7 | 347.18 | 451.23 | 20 |
| 320 | EIFER | 11.7 | 347.18 | 519.24 | 20 |
| 321 | EIFER | 11.7 | 347.18 | 564.31 | 20 |
| 322 | EIFYHYR | 13.31 | 514.25 | 785.37 | 28 |
| 323 | EIFYHYR | 13.31 | 514.25 | 853.39 | 28 |
| 324 | EIFYHYR | 13.32 | 514.25 | 898.46 | 28 |
| 325 | EIGDDK | 1.99 | 338.66 | 434.19 | 20 |
| 326 | EIGDDK | 1.99 | 338.66 | 530.21 | 20 |
| 327 | EIGDDK | 1.99 | 338.66 | 547.27 | 20 |
| 328 | EIGDGK | 1.76 | 309.66 | 376.18 | 19 |
| 329 | EIGDGK | 1.75 | 309.66 | 472.2 | 19 |
| 330 | EIGDGK | 1.75 | 309.66 | 489.27 | 19 |
| 331 | EIGEDK | 2.32 | 345.67 | 448.2 | 20 |
| 332 | EIGEDK | 2.33 | 345.67 | 544.22 | 20 |
| 333 | EIGEDK | 2.33 | 345.67 | 561.29 | 20 |
| 334 | EIGEDNAR | 10.05 | 452.21 | 604.27 | 25 |
| 335 | EIGEDNAR | 10.05 | 452.21 | 661.29 | 25 |
| 336 | EIGEDNAR | 10.06 | 452.21 | 774.37 | 25 |
| 337 | EIGENK | 1.86 | 345.18 | 447.22 | 20 |
| 338 | EIGENK | 1.86 | 345.18 | 543.24 | 20 |
| 339 | EIGENK | 1.86 | 345.18 | 560.3 | 20 |
| 340 | EIGSEIDK | 11.04 | 445.73 | 591.3 | 25 |
| 341 | EIGSEIDK | 11.04 | 445.73 | 648.32 | 25 |
| 342 | EIGSEIDK | 11.04 | 445.73 | 761.4 | 25 |

TABLE 30-continued

| Transition number | Peptide | Retention time (minutes) | (m/z) filtered in Q1 | (m/z) filtered in Q3 | Collision energy (eV) |
|---|---|---|---|---|---|
| 343 | EMIYLK | 15.11 | 398.72 | 536.34 | 23 |
| 344 | EMIYLK | 15.11 | 398.72 | 650.32 | 23 |
| 345 | EMIYLK | 15.11 | 398.72 | 667.38 | 23 |
| 346 | EMLYVER | 14.12 | 470.23 | 566.29 | 26 |
| 347 | EMLYVER | 14.12 | 470.23 | 679.38 | 26 |
| 348 | EMLYVER | 14.12 | 470.23 | 810.42 | 26 |
| 349 | ENIEK | 11.07 | 316.67 | 389.24 | 19 |
| 350 | ENIEK | 11.07 | 316.67 | 486.22 | 19 |
| 351 | ENIEK | 11.07 | 316.67 | 503.28 | 19 |
| 352 | ENQLIVK | 12.15 | 422.25 | 472.35 | 24 |
| 353 | ENQLIVK | 12.15 | 422.25 | 600.41 | 24 |
| 354 | ENQLIVK | 12.15 | 422.25 | 714.45 | 24 |
| 355 | EQAILLFR | 19.88 | 495.29 | 548.36 | 27 |
| 356 | EQAILLFR | 19.88 | 495.29 | 661.44 | 27 |
| 357 | EQAILLFR | 19.88 | 495.29 | 732.48 | 27 |
| 358 | EQIQFLLR | 19.45 | 523.8 | 548.36 | 28 |
| 359 | EQIQFLLR | 19.45 | 523.8 | 676.41 | 28 |
| 360 | EQIQFLLR | 19.45 | 523.8 | 789.5 | 28 |
| 361 | EQLAFDPQVQQQVK | 16.43 | 829.43 | 954.54 | 41 |
| 362 | EQLAFDPQVQQQVK | 16.42 | 829.43 | 1069.56 | 41 |
| 363 | EQLAFDPQVQQQVK | 16.42 | 829.43 | 1216.63 | 41 |
| 364 | EQVDFVQR | 13.09 | 510.76 | 549.31 | 27 |
| 365 | EQVDFVQR | 13.09 | 510.76 | 664.34 | 27 |
| 366 | EQVDFVQR | 13.09 | 510.76 | 763.41 | 27 |
| 367 | EVGEIR | 9.35 | 351.69 | 474.27 | 20 |
| 368 | EVGEIR | 9.35 | 351.69 | 528.27 | 20 |
| 369 | EVGEIR | 9.35 | 351.69 | 573.34 | 20 |
| 370 | EVGEVR | 6.91 | 344.68 | 460.25 | 20 |
| 371 | EVGEVR | 6.91 | 344.68 | 514.25 | 20 |
| 372 | EVGEVR | 6.91 | 344.68 | 559.32 | 20 |
| 373 | EYLPASTFK | 15.41 | 528.27 | 553.3 | 28 |
| 374 | EYLPASTFK | 15.41 | 528.27 | 650.35 | 28 |
| 375 | EYLPASTFK | 15.41 | 528.27 | 763.43 | 28 |
| 376 | EYLPVSTFK | 17.16 | 542.29 | 581.33 | 29 |
| 377 | EYLPVSTFK | 17.16 | 542.29 | 678.38 | 29 |
| 378 | EYLPVSTFK | 17.16 | 542.29 | 791.47 | 29 |
| 379 | EYNTSGTFVFYDGK | 18.2 | 814.37 | 1033.5 | 41 |
| 380 | EYNTSGTFVFYDGK | 18.2 | 814.37 | 1120.53 | 41 |

TABLE 30-continued

| Transition number | Peptide | Retention time (minutes) | (m/z) filtered in Q1 | (m/z) filtered in Q3 | Collision energy (eV) |
|---|---|---|---|---|---|
| 381 | EYNTSGTFVFYDGK | 18.2 | 814.37 | 1221.58 | 41 |
| 382 | EYVPASTFK | 13.89 | 521.27 | 553.3 | 28 |
| 383 | EYVPASTFK | 13.89 | 521.27 | 650.35 | 28 |
| 384 | EYVPASTFK | 13.89 | 521.27 | 749.42 | 28 |
| 385 | FAPESTFK | 13.67 | 463.73 | 482.26 | 25 |
| 386 | FAPESTFK | 13.67 | 463.73 | 611.3 | 25 |
| 387 | FAPESTFK | 13.67 | 463.73 | 708.36 | 25 |
| 388 | FAQYAK | 9.39 | 364.19 | 509.27 | 21 |
| 389 | FAQYAK | 9.39 | 364.19 | 580.31 | 21 |
| 390 | FAQYAK | 9.39 | 364.19 | 581.27 | 21 |
| 391 | FDYGNR | 10.1 | 386.17 | 509.25 | 22 |
| 392 | FDYGNR | 10.1 | 386.17 | 597.23 | 22 |
| 393 | FDYGNR | 10.09 | 386.17 | 624.27 | 22 |
| 394 | FEDLYK | 13.52 | 407.7 | 423.26 | 23 |
| 395 | FEDLYK | 13.52 | 407.7 | 538.29 | 23 |
| 396 | FEDLYK | 13.52 | 407.7 | 667.33 | 23 |
| 397 | FEDTFHISNQK | 14.33 | 455.89 | 476.25 | 27 |
| 398 | FEDTFHISNQK | 14.33 | 455.89 | 589.33 | 27 |
| 399 | FEDTFHISNQK | 14.33 | 455.89 | 726.39 | 27 |
| 400 | FEDTFHTSNQQHEK | 10.66 | 583.26 | 870.41 | 33 |
| 401 | FEDTFHTSNQQHEK | 10.66 | 583.26 | 971.45 | 33 |
| 402 | FEDTFHTSNQQHEK | 10.66 | 583.26 | 1108.51 | 33 |
| 403 | FEYGNQDVSGDSGK | 11.95 | 751.82 | 764.34 | 38 |
| 404 | FEYGNQDVSGDSGK | 11.95 | 751.82 | 1063.47 | 38 |
| 405 | FEYGNQDVSGDSGK | 11.95 | 751.82 | 1226.53 | 38 |
| 406 | FFSDFQAK | 16 | 495.24 | 608.3 | 27 |
| 407 | FFSDFQAK | 16 | 495.24 | 695.34 | 27 |
| 408 | FFSDFQAK | 16 | 495.24 | 842.4 | 27 |
| 409 | FFSDLQAEGAIVIADER | 20.44 | 627.65 | 1143.6 | 35 |
| 410 | FFSDLQAEGAIVIADER | 20.43 | 940.97 | 1143.6 | 46 |
| 411 | FFSDLQAEGAIVIADER | 20.44 | 940.97 | 1179.57 | 46 |
| 412 | FFSDLR | 15.38 | 392.7 | 490.26 | 22 |
| 413 | FFSDLR | 15.38 | 392.7 | 610.29 | 22 |
| 414 | FFSDLR | 15.38 | 392.7 | 637.33 | 22 |
| 415 | FFSEFQAK | 16.13 | 502.25 | 622.32 | 27 |
| 416 | FFSEFQAK | 16.13 | 502.25 | 709.35 | 27 |
| 417 | FFSEFQAK | 16.13 | 502.25 | 856.42 | 27 |
| 418 | FGLEGQLR | 15.8 | 460.25 | 473.28 | 25 |

TABLE 30-continued

| Transition number | Peptide | Retention time (minutes) | (m/z) filtered in Q1 | (m/z) filtered in Q3 | Collision energy (eV) |
|---|---|---|---|---|---|
| 419 | FGLEGQLR | 15.8 | 460.25 | 602.33 | 25 |
| 420 | FGLEGQLR | 15.8 | 460.25 | 772.43 | 25 |
| 421 | FLESLYLNNLPASK | 20.75 | 804.94 | 856.49 | 40 |
| 422 | FLESLYLNNLPASK | 20.75 | 804.94 | 1019.55 | 40 |
| 423 | FLESLYLNNLPASK | 20.75 | 804.94 | 1219.67 | 40 |
| 424 | FLLEGQLR | 18.06 | 488.28 | 602.33 | 26 |
| 425 | FLLEGQLR | 18.06 | 488.28 | 715.41 | 26 |
| 426 | FLLEGQLR | 18.06 | 488.28 | 828.49 | 26 |
| 427 | FQQYVDR | 11.19 | 478.24 | 552.28 | 26 |
| 428 | FQQYVDR | 11.19 | 478.24 | 680.34 | 26 |
| 429 | FQQYVDR | 11.19 | 478.24 | 808.39 | 26 |
| 430 | FSDYVQR | 11.83 | 457.72 | 565.31 | 25 |
| 431 | FSDYVQR | 11.83 | 457.72 | 680.34 | 25 |
| 432 | FSDYVQR | 11.83 | 457.72 | 767.37 | 25 |
| 433 | FSTASTFK | 12.71 | 444.73 | 553.3 | 25 |
| 434 | FSTASTFK | 12.7 | 444.73 | 654.35 | 25 |
| 435 | FSTASTFK | 12.7 | 444.73 | 741.38 | 25 |
| 436 | FSWDGK | 14.32 | 370.17 | 505.24 | 21 |
| 437 | FSWDGK | 14.32 | 370.17 | 592.27 | 21 |
| 438 | FSWDGK | 14.32 | 370.17 | 593.24 | 21 |
| 439 | FSYGNQNISGGIDK | 14.61 | 750.36 | 803.43 | 38 |
| 440 | FSYGNQNISGGIDK | 14.61 | 750.36 | 1045.53 | 38 |
| 441 | FSYGNQNISGGIDK | 14.61 | 750.36 | 1102.55 | 38 |
| 442 | FSYGNQNISGGTDK | 12.74 | 744.34 | 791.39 | 38 |
| 443 | FSYGNQNISGGTDK | 12.74 | 744.34 | 1033.49 | 38 |
| 444 | FSYGNQNISGGTDK | 12.74 | 744.34 | 1090.51 | 38 |
| 445 | FSYGSQNISGGIDK | 14.74 | 736.85 | 803.43 | 37 |
| 446 | FSYGSQNISGGIDK | 14.74 | 736.85 | 1075.54 | 37 |
| 447 | FSYGSQNISGGIDK | 14.75 | 736.85 | 1238.6 | 37 |
| 448 | FTEYVK | 11.81 | 393.71 | 538.29 | 22 |
| 449 | FTEYVK | 11.81 | 393.71 | 639.33 | 22 |
| 450 | FTEYVK | 11.81 | 393.71 | 640.3 | 22 |
| 451 | FVPASTYK | 11.76 | 456.74 | 498.26 | 25 |
| 452 | FVPASTYK | 11.76 | 456.74 | 569.29 | 25 |
| 453 | FVPASTYK | 11.77 | 456.74 | 666.35 | 25 |
| 454 | FVYDLAQGQLPFKPEVQQQVK | 20.48 | 821.44 | 955.52 | 45 |
| 455 | FVYDLAQGQLPFKPEVQQQVK | 20.48 | 821.44 | 1108.59 | 45 |
| 456 | FVYDLAQGQLPFKPEVQQQVK | 20.49 | 821.44 | 1109.07 | 45 |

TABLE 30-continued

| Transition number | Peptide | Retention time (minutes) | (m/z) filtered in Q1 | (m/z) filtered in Q3 | Collision energy (eV) |
|---|---|---|---|---|---|
| 457 | FWLEDQLR | 20.39 | 553.79 | 660.33 | 29 |
| 458 | FWLEDQLR | 20.39 | 553.79 | 773.42 | 29 |
| 459 | FWLEDQLR | 20.38 | 553.79 | 959.49 | 29 |
| 460 | FWLEGPLK | 20.63 | 495.28 | 543.31 | 27 |
| 461 | FWLEGPLK | 20.63 | 495.28 | 656.4 | 27 |
| 462 | FWLEGPLK | 20.63 | 495.28 | 842.48 | 27 |
| 463 | FWLEGQLR | 19.49 | 524.78 | 602.33 | 28 |
| 464 | FWLEGQLR | 19.49 | 524.78 | 715.41 | 28 |
| 465 | FWLEGQLR | 19.48 | 524.78 | 901.49 | 28 |
| 466 | FYPASSFK | 14.74 | 473.74 | 636.34 | 26 |
| 467 | FYPASSFK | 14.74 | 473.74 | 799.4 | 26 |
| 468 | FYPASSFK | 14.74 | 473.74 | 800.36 | 26 |
| 469 | FYPASTFK | 14.98 | 480.74 | 553.3 | 26 |
| 470 | FYPASTFK | 14.99 | 480.74 | 650.35 | 26 |
| 471 | FYPASTFK | 14.98 | 480.74 | 813.41 | 26 |
| 472 | GAIQVSAVPVFQQIAR | 21.6 | 842.48 | 958.55 | 42 |
| 473 | GAIQVSAVPVFQQIAR | 21.6 | 842.48 | 1057.62 | 42 |
| 474 | GAIQVSAVPVFQQIAR | 21.59 | 842.48 | 1128.65 | 42 |
| 475 | GAIQVSAVPVFQQITR | 21.52 | 857.49 | 988.56 | 43 |
| 476 | GAIQVSAVPVFQQITR | 21.51 | 857.49 | 1087.63 | 43 |
| 477 | GAIQVSAVPVFQQITR | 21.52 | 857.49 | 1158.66 | 43 |
| 478 | GELPVSEDALEMTK | 18.1 | 759.87 | 936.43 | 38 |
| 479 | GELPVSEDALEMTK | 18.11 | 759.87 | 1023.47 | 38 |
| 480 | GELPVSEDALEMTK | 18.11 | 759.87 | 1122.53 | 38 |
| 481 | GISSSVR | 8.65 | 353.2 | 448.25 | 21 |
| 482 | GISSSVR | 8.65 | 353.2 | 535.28 | 21 |
| 483 | GISSSVR | 8.67 | 353.2 | 648.37 | 21 |
| 484 | GNQTLVFAR | 14.83 | 503.28 | 605.38 | 27 |
| 485 | GNQTLVFAR | 14.83 | 503.28 | 706.42 | 27 |
| 486 | GNQTLVFAR | 14.83 | 503.28 | 834.48 | 27 |
| 487 | GPLEISAFEEAR | 18.95 | 659.84 | 809.38 | 34 |
| 488 | GPLEISAFEEAR | 18.94 | 659.84 | 922.46 | 34 |
| 489 | GPLEISAFEEAR | 18.94 | 659.84 | 1051.51 | 34 |
| 490 | GPLTITPIQEVK | 18.14 | 648.38 | 814.47 | 34 |
| 491 | GPLTITPIQEVK | 18.15 | 648.38 | 927.55 | 34 |
| 492 | GPLTITPIQEVK | 18.14 | 648.38 | 1028.6 | 34 |
| 493 | GSLLLWDQK | 19.61 | 530.3 | 576.28 | 28 |
| 494 | GSLLLWDQK | 19.61 | 530.3 | 689.36 | 28 |

TABLE 30-continued

| Transition number | Peptide | Retention time (minutes) | (m/z) filtered in Q1 | (m/z) filtered in Q3 | Collision energy (eV) |
|---|---|---|---|---|---|
| 495 | GSLLLWDQK | 19.61 | 530.3 | 802.45 | 28 |
| 496 | GTFVLYDVQR | 17.93 | 599.32 | 680.34 | 31 |
| 497 | GTFVLYDVQR | 17.93 | 599.32 | 793.42 | 31 |
| 498 | GTFVLYDVQR | 17.93 | 599.32 | 892.49 | 31 |
| 499 | GTIVVADER | 11.82 | 480.26 | 490.23 | 26 |
| 500 | GTIVVADER | 11.82 | 480.26 | 589.29 | 26 |
| 501 | GTIVVADER | 11.82 | 480.26 | 688.36 | 26 |
| 502 | GTIVVLDAR | 15.77 | 472.28 | 573.34 | 26 |
| 503 | GTIVVLDAR | 15.77 | 472.28 | 672.4 | 26 |
| 504 | GTIVVLDAR | 15.77 | 472.28 | 785.49 | 26 |
| 505 | GTIVVVDER | 13.6 | 494.28 | 518.26 | 27 |
| 506 | GTIVVVDER | 13.6 | 494.28 | 617.33 | 27 |
| 507 | GTIVVVDER | 13.6 | 494.28 | 716.39 | 27 |
| 508 | GTLPFSAR | 14.96 | 424.73 | 577.31 | 24 |
| 509 | GTLPFSAR | 14.96 | 424.73 | 690.39 | 24 |
| 510 | GTLPFSAR | 14.97 | 424.73 | 791.44 | 24 |
| 511 | HIADSK | 11.91 | 335.68 | 420.21 | 20 |
| 512 | HIADSK | 11.9 | 335.68 | 524.25 | 20 |
| 513 | HIADSK | 11.91 | 335.68 | 533.29 | 20 |
| 514 | HNGTDGAWIISSLR | 19.36 | 509.6 | 575.35 | 29 |
| 515 | HNGTDGAWIISSLR | 19.35 | 509.6 | 653.26 | 29 |
| 516 | HNGTDGAWIISSLR | 19.36 | 509.6 | 688.44 | 29 |
| 517 | HTLSVFDQER | 14.25 | 411.21 | 432.22 | 25 |
| 518 | HTLSVFDQER | 14.25 | 411.21 | 547.25 | 25 |
| 519 | HTLSVFDQER | 14.25 | 411.21 | 694.32 | 25 |
| 520 | HVTFASFR | 14.36 | 322.17 | 338.18 | 20 |
| 521 | HVTFASFR | 14.36 | 322.17 | 409.22 | 20 |
| 522 | HVTFASFR | 14.36 | 322.17 | 485.25 | 20 |
| 523 | IAISLMGYDAGFLR | 23.93 | 763.91 | 898.44 | 39 |
| 524 | IAISLMGYDAGFLR | 23.93 | 763.91 | 1029.48 | 39 |
| 525 | IAISLMGYDAGFLR | 23.94 | 763.91 | 1229.6 | 39 |
| 526 | IALSLMGFDSGILK | 24.91 | 732.91 | 836.45 | 37 |
| 527 | IALSLMGFDSGILK | 24.91 | 732.91 | 967.49 | 37 |
| 528 | IALSLMGFDSGILK | 24.91 | 732.91 | 1167.61 | 37 |
| 529 | IANALIGLENHK | 15.95 | 431.58 | 697.36 | 26 |
| 530 | IANALIGLENHK | 15.95 | 646.87 | 697.36 | 33 |
| 531 | IANALIGLENHK | 15.95 | 646.87 | 810.45 | 33 |
| 532 | IDTFWLDNSLK | 21.79 | 676.35 | 689.38 | 35 |

TABLE 30-continued

| Transition number | Peptide | Retention time (minutes) | (m/z) filtered in Q1 | (m/z) filtered in Q3 | Collision energy (eV) |
|---|---|---|---|---|---|
| 533 | IDTFWLDNSLK | 21.79 | 676.35 | 875.46 | 35 |
| 534 | IDTFWLDNSLK | 21.79 | 676.35 | 1123.58 | 35 |
| 535 | IDYYNLDR | 14.85 | 536.26 | 680.34 | 29 |
| 536 | IDYYNLDR | 14.85 | 536.26 | 843.4 | 29 |
| 537 | IDYYNLDR | 14.85 | 536.26 | 958.43 | 29 |
| 538 | IFNALIALDSGVIK | 24.74 | 737.44 | 802.47 | 37 |
| 539 | IFNALIALDSGVIK | 24.74 | 737.44 | 915.55 | 37 |
| 540 | IFNALIALDSGVIK | 24.74 | 737.44 | 1028.64 | 37 |
| 541 | IFNSLLALDSGALDNER | 22.76 | 924.48 | 976.43 | 46 |
| 542 | IFNSLLALDSGALDNER | 22.77 | 924.48 | 1089.52 | 46 |
| 543 | IFNSLLALDSGALDNER | 22.76 | 924.48 | 1160.55 | 46 |
| 544 | IFNTLIGLENGIVK | 23.29 | 765.95 | 829.48 | 39 |
| 545 | IFNTLIGLENGIVK | 23.3 | 765.95 | 942.56 | 39 |
| 546 | IFNTLIGLENGIVK | 23.3 | 765.95 | 1055.65 | 39 |
| 547 | IGLDLMQK | 17.7 | 459.26 | 634.32 | 25 |
| 548 | IGLDLMQK | 17.7 | 459.26 | 747.41 | 25 |
| 549 | IGLDLMQK | 17.7 | 459.26 | 804.43 | 25 |
| 550 | IGLEK | 8.54 | 280.18 | 389.24 | 17 |
| 551 | IGLEK | 8.55 | 280.18 | 413.24 | 17 |
| 552 | IGLEK | 8.54 | 280.18 | 446.26 | 17 |
| 553 | IGLELMQQEVQR | 18.73 | 722.38 | 787.41 | 37 |
| 554 | IGLELMQQEVQR | 18.73 | 722.38 | 918.45 | 37 |
| 555 | IGLELMQQEVQR | 18.73 | 722.38 | 1031.53 | 37 |
| 556 | IGLELMSK | 17.52 | 445.75 | 478.27 | 25 |
| 557 | IGLELMSK | 17.52 | 445.75 | 720.4 | 25 |
| 558 | IGLELMSK | 17.52 | 445.75 | 777.42 | 25 |
| 559 | IGLELMSNEVK | 18.73 | 616.83 | 707.34 | 32 |
| 560 | IGLELMSNEVK | 18.73 | 616.83 | 820.42 | 32 |
| 561 | IGLELMSNEVK | 18.73 | 616.83 | 949.47 | 32 |
| 562 | IGLER | 10.96 | 294.18 | 304.16 | 18 |
| 563 | IGLER | 10.96 | 294.18 | 417.25 | 18 |
| 564 | IGLER | 10.96 | 294.18 | 474.27 | 18 |
| 565 | IGLNK | 9.59 | 272.68 | 374.24 | 17 |
| 566 | IGLNK | 9.59 | 272.68 | 398.24 | 17 |
| 567 | IGLNK | 9.59 | 272.68 | 431.26 | 17 |
| 568 | IGLNLMQK | 17.1 | 458.77 | 633.34 | 25 |
| 569 | IGLNLMQK | 17.09 | 458.77 | 746.42 | 25 |
| 570 | IGLNLMQK | 17.11 | 458.77 | 803.44 | 25 |

TABLE 30-continued

| Transition number | Peptide | Retention time (minutes) | (m/z) filtered in Q1 | (m/z) filtered in Q3 | Collision energy (eV) |
|---|---|---|---|---|---|
| 571 | IGPSLMQSELQR | 17.02 | 679.86 | 760.39 | 35 |
| 572 | IGPSLMQSELQR | 17.02 | 679.86 | 891.44 | 35 |
| 573 | IGPSLMQSELQR | 17.02 | 679.86 | 1188.6 | 35 |
| 574 | IGYGNMQIGTEVDQFWLK | 24.31 | 700.35 | 935.5 | 39 |
| 575 | IGYGNMQIGTEVDQFWLK | 24.32 | 1050.02 | 1164.54 | 51 |
| 576 | IGYGNMQIGTEVDQFWLK | 24.3 | 1050.02 | 1222.61 | 51 |
| 577 | IINHNLPVK | 11.88 | 349.88 | 456.32 | 21 |
| 578 | IINHNLPVK | 11.88 | 349.88 | 570.36 | 21 |
| 579 | IINHNLPVK | 11.88 | 349.88 | 592.32 | 21 |
| 580 | IINHNLPVR | 12.04 | 359.22 | 598.37 | 22 |
| 581 | IINHNLPVR | 12.04 | 538.32 | 598.37 | 29 |
| 582 | IINHNLPVR | 12.04 | 538.32 | 849.47 | 29 |
| 583 | ILFQQGTQQAC[CAM]AER | 14.51 | 550.61 | 606.27 | 32 |
| 584 | ILFQQGTQQAC[CAM]AER | 14.51 | 825.41 | 1020.45 | 41 |
| 585 | ILFQQGTQQAC[CAM]AER | 14.51 | 825.41 | 1148.51 | 41 |
| 586 | ILNNWFK | 18.98 | 467.76 | 594.3 | 26 |
| 587 | ILNNWFK | 18.98 | 467.76 | 708.35 | 26 |
| 588 | ILNNWFK | 18.97 | 467.76 | 821.43 | 26 |
| 589 | ILNTLISLEEK | 19.98 | 636.87 | 718.4 | 33 |
| 590 | ILNTLISLEEK | 19.98 | 636.87 | 1046.57 | 33 |
| 591 | ILNTLISLEEK | 19.98 | 636.87 | 1159.66 | 33 |
| 592 | INIVK | 11.43 | 293.7 | 359.27 | 18 |
| 593 | INIVK | 11.43 | 293.7 | 440.29 | 18 |
| 594 | INIVK | 11.43 | 293.7 | 473.31 | 18 |
| 595 | INLYGNALSR | 16.05 | 560.81 | 617.34 | 30 |
| 596 | INLYGNALSR | 16.05 | 560.81 | 780.4 | 30 |
| 597 | INLYGNALSR | 16.05 | 560.81 | 893.48 | 30 |
| 598 | IPFSLNLEMK | 21.68 | 596.33 | 834.44 | 31 |
| 599 | IPFSLNLEMK | 21.67 | 596.33 | 981.51 | 31 |
| 600 | IPFSLNLEMK | 21.67 | 596.33 | 1078.56 | 31 |
| 601 | IPHTLFALDADAVR | 20 | 513.62 | 531.29 | 30 |
| 602 | IPHTLFALDADAVR | 20 | 513.62 | 646.32 | 30 |
| 603 | IPHTLFALDADAVR | 20 | 769.92 | 1191.64 | 39 |
| 604 | IPHTLFALDAGAAR | 18.58 | 726.9 | 744.4 | 37 |
| 605 | IPHTLFALDAGAAR | 18.58 | 726.9 | 891.47 | 37 |
| 606 | IPHTLFALDAGAAR | 18.58 | 726.9 | 1004.55 | 37 |
| 607 | IPHTLFALDAGAVR | 19.72 | 494.28 | 588.31 | 29 |
| 608 | IPHTLFALDAGAVR | 19.71 | 494.28 | 780.44 | 29 |

TABLE 30-continued

| Transition number | Peptide | Retention time (minutes) | (m/z) filtered in Q1 | (m/z) filtered in Q3 | Collision energy (eV) |
|---|---|---|---|---|---|
| 609 | IPHTLFALDAGAVR | 19.72 | 740.92 | 1133.63 | 38 |
| 610 | IPNAIIGLETGVIK | 21.75 | 719.44 | 816.48 | 37 |
| 611 | IPNAIIGLETGVIK | 21.75 | 719.44 | 929.57 | 37 |
| 612 | IPNAIIGLETGVIK | 21.75 | 719.44 | 1227.73 | 37 |
| 613 | IPNALIGLETGAIK | 20.96 | 705.42 | 788.45 | 36 |
| 614 | IPNALIGLETGAIK | 20.96 | 705.42 | 901.54 | 36 |
| 615 | IPNALIGLETGAIK | 20.96 | 705.42 | 1014.62 | 36 |
| 616 | IPNSLIAFDTGAVR | 20.24 | 737.41 | 765.39 | 37 |
| 617 | IPNSLIAFDTGAVR | 20.24 | 737.41 | 836.43 | 37 |
| 618 | IPNSLIAFDTGAVR | 20.24 | 737.41 | 949.51 | 37 |
| 619 | IPSAIIGLETGVIK | 21.66 | 705.93 | 816.48 | 36 |
| 620 | IPSAIIGLETGVIK | 21.67 | 705.93 | 929.57 | 36 |
| 621 | IPSAIIGLETGVIK | 21.66 | 705.93 | 1200.72 | 36 |
| 622 | ISAFNQVK | 13.02 | 453.76 | 488.28 | 25 |
| 623 | ISAFNQVK | 13.02 | 453.76 | 706.39 | 25 |
| 624 | ISAFNQVK | 13.02 | 453.76 | 793.42 | 25 |
| 625 | ISAHEQILFLR | 18.28 | 442.92 | 548.36 | 26 |
| 626 | ISAHEQILFLR | 18.28 | 442.92 | 789.5 | 26 |
| 627 | ISAHEQILFLR | 18.28 | 663.88 | 918.54 | 34 |
| 628 | ISAMEQTR | 9.84 | 468.23 | 664.31 | 26 |
| 629 | ISAMEQTR | 9.84 | 468.23 | 735.35 | 26 |
| 630 | ISAMEQTR | 9.84 | 468.23 | 822.38 | 26 |
| 631 | ISAMEQVK | 11.65 | 453.24 | 634.32 | 25 |
| 632 | ISAMEQVK | 11.65 | 453.24 | 705.36 | 25 |
| 633 | ISAMEQVK | 11.65 | 453.24 | 792.39 | 25 |
| 634 | ISATEQVAFLR | 17.7 | 412.23 | 435.27 | 25 |
| 635 | ISATEQVAFLR | 17.71 | 412.23 | 506.31 | 25 |
| 636 | ISATEQVAFLR | 17.7 | 412.23 | 605.38 | 25 |
| 637 | ISATQQIAFLR | 18.58 | 624.36 | 747.45 | 32 |
| 638 | ISATQQIAFLR | 18.58 | 624.36 | 1047.59 | 32 |
| 639 | ISATQQIAFLR | 18.58 | 624.36 | 1134.63 | 32 |
| 640 | ISAVNQVEFLESLFLNK | 28.77 | 976.03 | 988.51 | 48 |
| 641 | ISAVNQVEFLESLFLNK | 28.77 | 976.03 | 1110.62 | 48 |
| 642 | ISAVNQVEFLESLFLNK | 28.77 | 976.03 | 1239.66 | 48 |
| 643 | ISAVNQVK | 10.32 | 429.76 | 488.28 | 24 |
| 644 | ISAVNQVK | 10.32 | 429.76 | 658.39 | 24 |
| 645 | ISAVNQVK | 10.32 | 429.76 | 745.42 | 24 |
| 646 | ISPEEQIQFLR | 18.87 | 680.37 | 933.52 | 35 |

TABLE 30-continued

| Transition number | Peptide | Retention time (minutes) | (m/z) filtered in Q1 | (m/z) filtered in Q3 | Collision energy (eV) |
|---|---|---|---|---|---|
| 647 | ISPEEQIQFLR | 18.87 | 680.37 | 1062.56 | 35 |
| 648 | ISPEEQIQFLR | 18.87 | 680.37 | 1159.61 | 35 |
| 649 | ISPEEQVR | 10.49 | 479.25 | 531.29 | 26 |
| 650 | ISPEEQVR | 10.49 | 479.25 | 660.33 | 26 |
| 651 | ISPEEQVR | 10.49 | 479.25 | 757.38 | 26 |
| 652 | ISPEGQVR | 9.86 | 443.24 | 459.27 | 25 |
| 653 | ISPEGQVR | 9.86 | 443.24 | 588.31 | 25 |
| 654 | ISPEGQVR | 9.86 | 443.24 | 685.36 | 25 |
| 655 | ISPLEQLAFLR | 24.02 | 643.88 | 876.49 | 33 |
| 656 | ISPLEQLAFLR | 24.01 | 643.88 | 989.58 | 33 |
| 657 | ISPLEQLAFLR | 24.02 | 643.88 | 1086.63 | 33 |
| 658 | ITAFQQVDFLR | 21.11 | 669.36 | 777.43 | 34 |
| 659 | ITAFQQVDFLR | 21.12 | 669.36 | 905.48 | 34 |
| 660 | ITAFQQVDFLR | 21.12 | 669.36 | 1123.59 | 34 |
| 661 | ITPIQEVNFADDFANNR | 21.25 | 655.32 | 736.34 | 37 |
| 662 | ITPIQEVNFADDFANNR | 21.25 | 655.32 | 851.36 | 37 |
| 663 | ITPIQEVNFADDFANNR | 21.25 | 655.32 | 922.4 | 37 |
| 664 | ITPIQEVNFADDLANNR | 20.95 | 643.99 | 817.38 | 36 |
| 665 | ITPIQEVNFADDLANNR | 20.95 | 965.49 | 1149.53 | 47 |
| 666 | ITPIQEVNFADDLANNR | 20.96 | 965.49 | 1248.6 | 47 |
| 667 | ITPQQEAQFAYK | 14.52 | 712.36 | 856.42 | 36 |
| 668 | ITPQQEAQFAYK | 14.52 | 712.36 | 984.48 | 36 |
| 669 | ITPQQEAQFAYK | 14.52 | 712.36 | 1209.59 | 36 |
| 670 | ITPQQEAQFTYK | 14.33 | 485.25 | 558.29 | 28 |
| 671 | ITPQQEAQFTYK | 14.33 | 727.37 | 1014.49 | 37 |
| 672 | ITPQQEAQFTYK | 14.33 | 727.37 | 1239.6 | 37 |
| 673 | ITPVQEVNFADDLAHNR | 18.98 | 646.99 | 840.4 | 36 |
| 674 | ITPVQEVNFADDLAHNR | 18.98 | 646.99 | 862.92 | 36 |
| 675 | ITPVQEVNFADDLAHNR | 18.98 | 646.99 | 911.43 | 36 |
| 676 | IVAFALK | 17.21 | 381.25 | 478.3 | 22 |
| 677 | IVAFALK | 17.22 | 381.25 | 549.34 | 22 |
| 678 | IVAFALK | 17.21 | 381.25 | 648.41 | 22 |
| 679 | IVAFALNMEMR | 17.95 | 647.84 | 864.41 | 34 |
| 680 | IVAFALNMEMR | 17.95 | 647.84 | 1011.48 | 34 |
| 681 | IVAFALNMEMR | 17.97 | 647.84 | 1082.51 | 34 |
| 682 | IVESTTLADGTVVHGK | 13.69 | 542.96 | 697.4 | 31 |
| 683 | IVESTTLADGTVVHGK | 13.69 | 542.96 | 812.43 | 31 |
| 684 | IVESTTLADGTVVHGK | 13.68 | 542.96 | 883.46 | 31 |

TABLE 30-continued

| Transition number | Peptide | Retention time (minutes) | (m/z) filtered in Q1 | (m/z) filtered in Q3 | Collision energy (eV) |
|---|---|---|---|---|---|
| 685 | IYNSLIGLNEK | 17.37 | 632.35 | 673.39 | 33 |
| 686 | IYNSLIGLNEK | 17.37 | 632.35 | 786.47 | 33 |
| 687 | IYNSLIGLNEK | 17.37 | 632.35 | 987.55 | 33 |
| 688 | KPDIGWWVGWIER | 24.47 | 547.96 | 660.35 | 31 |
| 689 | KPDIGWWVGWIER | 24.47 | 547.96 | 883.45 | 31 |
| 690 | KPDIGWWVGWIER | 24.46 | 821.43 | 1188.59 | 41 |
| 691 | LAC[CAM]ATNNLAR | 11.22 | 552.28 | 688.37 | 29 |
| 692 | LAC[CAM]ATNNLAR | 11.22 | 552.28 | 759.41 | 29 |
| 693 | LAC[CAM]ATNNLAR | 11.22 | 552.28 | 919.44 | 29 |
| 694 | LAQGELPFPAPVQSTVR | 19.84 | 905.5 | 954.54 | 45 |
| 695 | LAQGELPFPAPVQSTVR | 19.84 | 905.5 | 1101.61 | 45 |
| 696 | LAQGELPFPAPVQSTVR | 19.84 | 905.5 | 1198.66 | 45 |
| 697 | LAQNELPYPIEIQK | 19.09 | 828.45 | 929.47 | 41 |
| 698 | LAQNELPYPIEIQK | 19.09 | 828.45 | 987.55 | 41 |
| 699 | LAQNELPYPIEIQK | 19.08 | 828.45 | 1100.64 | 41 |
| 700 | LAQNELQYPIEIQK | 17.98 | 843.96 | 890.5 | 42 |
| 701 | LAQNELQYPIEIQK | 17.98 | 843.96 | 1018.56 | 42 |
| 702 | LAQNELQYPIEIQK | 17.98 | 843.96 | 1131.64 | 42 |
| 703 | LDFGNK | 11.75 | 347.18 | 465.25 | 20 |
| 704 | LDFGNK | 11.74 | 347.18 | 547.25 | 20 |
| 705 | LDFGNK | 11.75 | 347.18 | 580.27 | 20 |
| 706 | LDGSLNR | 9.48 | 387.71 | 402.25 | 22 |
| 707 | LDGSLNR | 9.48 | 387.71 | 546.3 | 22 |
| 708 | LDGSLNR | 9.48 | 387.71 | 661.33 | 22 |
| 709 | LEILQQALAELGLYPK | 29.81 | 900.02 | 1003.58 | 45 |
| 710 | LEILQQALAELGLYPK | 29.81 | 900.02 | 1074.62 | 45 |
| 711 | LEILQQALAELGLYPK | 29.81 | 900.02 | 1202.68 | 45 |
| 712 | LENQEQVK | 7.6 | 494.26 | 631.34 | 27 |
| 713 | LENQEQVK | 7.59 | 494.26 | 745.38 | 27 |
| 714 | LENQEQVK | 7.59 | 494.26 | 874.43 | 27 |
| 715 | LETQEEVEK | 9.88 | 552.77 | 633.31 | 29 |
| 716 | LETQEEVEK | 9.88 | 552.77 | 862.42 | 29 |
| 717 | LETQEEVEK | 9.88 | 552.77 | 991.46 | 29 |
| 718 | LETQEEVK | 9.5 | 488.25 | 504.27 | 26 |
| 719 | LETQEEVK | 9.49 | 488.25 | 733.37 | 26 |
| 720 | LETQEEVK | 9.49 | 488.25 | 862.42 | 26 |
| 721 | LFAAEGVK | 13.53 | 417.74 | 503.28 | 23 |
| 722 | LFAAEGVK | 13.53 | 417.74 | 574.32 | 23 |

TABLE 30-continued

| Transition number | Peptide | Retention time (minutes) | (m/z) filtered in Q1 | (m/z) filtered in Q3 | Collision energy (eV) |
|---|---|---|---|---|---|
| 723 | LFAAEGVK | 13.53 | 417.74 | 721.39 | 23 |
| 724 | LFESAGVK | 12.99 | 425.74 | 461.27 | 24 |
| 725 | LFESAGVK | 12.99 | 425.74 | 590.31 | 24 |
| 726 | LFESAGVK | 12.99 | 425.74 | 737.38 | 24 |
| 727 | LFGAAGVK | 13.94 | 381.73 | 445.28 | 22 |
| 728 | LFGAAGVK | 13.94 | 381.73 | 502.3 | 22 |
| 729 | LFGAAGVK | 13.94 | 381.73 | 649.37 | 22 |
| 730 | LGVDR | 8.51 | 280.16 | 290.15 | 17 |
| 731 | LGVDR | 8.51 | 280.16 | 389.21 | 17 |
| 732 | LGVDR | 8.5 | 280.16 | 446.24 | 17 |
| 733 | LLNLLSQSK | 17.97 | 508.31 | 562.32 | 27 |
| 734 | LLNLLSQSK | 17.97 | 508.31 | 789.45 | 27 |
| 735 | LLNLLSQSK | 17.97 | 508.31 | 902.53 | 27 |
| 736 | LLQDER | 9.34 | 387.21 | 547.25 | 22 |
| 737 | LLQDER | 9.31 | 387.21 | 599.3 | 22 |
| 738 | LLQDER | 9.34 | 387.21 | 660.33 | 22 |
| 739 | LLVQDGDC[CAM]GR | 11.92 | 566.77 | 679.25 | 30 |
| 740 | LLVQDGDC[CAM]GR | 11.92 | 566.77 | 807.3 | 30 |
| 741 | LLVQDGDC[CAM]GR | 11.92 | 566.77 | 906.37 | 30 |
| 742 | LNEVGYGNR | 10.74 | 511.26 | 566.27 | 27 |
| 743 | LNEVGYGNR | 10.74 | 511.26 | 665.34 | 27 |
| 744 | LNEVGYGNR | 10.73 | 511.26 | 794.38 | 27 |
| 745 | LNYGNADPSTK | 10.76 | 590.29 | 732.35 | 31 |
| 746 | LNYGNADPSTK | 10.76 | 590.29 | 789.37 | 31 |
| 747 | LNYGNADPSTK | 10.76 | 590.29 | 952.44 | 31 |
| 748 | LNYGNK | 7.21 | 354.69 | 481.24 | 21 |
| 749 | LNYGNK | 7.24 | 354.69 | 562.26 | 21 |
| 750 | LNYGNK | 7.22 | 354.69 | 595.28 | 21 |
| 751 | LPASK | 1.93 | 258.16 | 305.18 | 16 |
| 752 | LPASK | 1.93 | 258.16 | 369.21 | 16 |
| 753 | LPASK | 1.93 | 258.16 | 402.23 | 16 |
| 754 | LPHTLFALDADAVR | 19.98 | 769.92 | 977.51 | 39 |
| 755 | LPHTLFALDADAVR | 19.98 | 769.92 | 1090.59 | 39 |
| 756 | LPHTLFALDADAVR | 19.98 | 769.92 | 1191.64 | 39 |
| 757 | LPHTLFALDAGAVR | 19.7 | 740.92 | 919.5 | 38 |
| 758 | LPHTLFALDAGAVR | 19.67 | 740.92 | 1032.58 | 38 |
| 759 | LPHTLFALDAGAVR | 19.7 | 740.92 | 1133.63 | 38 |
| 760 | LPLAIMGFDSGILQSPK | 25.08 | 893.99 | 944.5 | 44 |

TABLE 30-continued

| Transition number | Peptide | Retention time (minutes) | (m/z) filtered in Q1 | (m/z) filtered in Q3 | Collision energy (eV) |
|---|---|---|---|---|---|
| 761 | LPLAIMGFDSGILQSPK | 25.08 | 893.99 | 1091.57 | 44 |
| 762 | LPLAIMGFDSGILQSPK | 25.08 | 893.99 | 1148.59 | 44 |
| 763 | LPLAIMGYDADILLDATTPR | 27.86 | 720.39 | 773.42 | 40 |
| 764 | LPLAIMGYDADILLDATTPR | 27.87 | 720.39 | 886.5 | 40 |
| 765 | LPLAIMGYDADILLDATTPR | 27.87 | 720.39 | 1160.57 | 40 |
| 766 | LPSSLIALETGAVR | 20.6 | 713.92 | 816.46 | 36 |
| 767 | LPSSLIALETGAVR | 20.6 | 713.92 | 929.54 | 36 |
| 768 | LPSSLIALETGAVR | 20.6 | 713.92 | 1216.69 | 36 |
| 769 | LPVSAQTLQYTANILK | 21.84 | 880.5 | 950.53 | 44 |
| 770 | LPVSAQTLQYTANILK | 21.84 | 880.5 | 1063.61 | 44 |
| 771 | LPVSAQTLQYTANILK | 21.85 | 880.5 | 1164.66 | 44 |
| 772 | LPVSER | 9.57 | 350.7 | 490.26 | 20 |
| 773 | LPVSER | 9.57 | 350.7 | 526.29 | 20 |
| 774 | LPVSER | 9.57 | 350.7 | 587.31 | 20 |
| 775 | LPVSPTAVDMTER | 16.21 | 708.36 | 1019.48 | 36 |
| 776 | LPVSPTAVDMTER | 16.21 | 708.36 | 1106.51 | 36 |
| 777 | LPVSPTAVDMTER | 16.21 | 708.36 | 1205.58 | 36 |
| 778 | LSASK | 10.72 | 253.15 | 305.18 | 16 |
| 779 | LSASK | 10.71 | 253.15 | 359.19 | 16 |
| 780 | LSASK | 10.71 | 253.15 | 392.21 | 16 |
| 781 | LSAVPIYQEVAR | 17.96 | 673.38 | 765.39 | 35 |
| 782 | LSAVPIYQEVAR | 17.96 | 673.38 | 975.53 | 35 |
| 783 | LSAVPIYQEVAR | 17.95 | 673.38 | 1074.59 | 35 |
| 784 | LSAVPVYQELAR | 18.45 | 449.25 | 616.34 | 26 |
| 785 | LSAVPVYQELAR | 18.44 | 673.38 | 779.4 | 35 |
| 786 | LSAVPVYQELAR | 18.44 | 673.38 | 975.53 | 35 |
| 787 | LSC[CAM]TLVIDEASGDLLHR | 20.38 | 633.66 | 797.43 | 36 |
| 788 | LSC[CAM]TLVIDEASGDLLHR | 20.38 | 633.66 | 868.46 | 36 |
| 789 | LSC[CAM]TLVIDEASGDLLHR | 20.38 | 633.66 | 1112.53 | 36 |
| 790 | LSLQHGWFIGWIEK | 23.95 | 571.98 | 632.34 | 33 |
| 791 | LSLQHGWFIGWIEK | 23.95 | 571.98 | 892.49 | 33 |
| 792 | LSLQHGWFIGWIEK | 23.95 | 571.98 | 969.49 | 33 |
| 793 | LSQNSLPFSQEAMNSVK | 18.64 | 627.31 | 1140.54 | 35 |
| 794 | LSQNSLPFSQEAMNSVK | 18.63 | 940.46 | 1140.54 | 46 |
| 795 | LSQNSLPFSQEAMNSVK | 18.64 | 940.46 | 1237.59 | 46 |
| 796 | LSVNPK | 9.8 | 329.2 | 457.28 | 19 |
| 797 | LSVNPK | 9.79 | 329.2 | 511.29 | 19 |
| 798 | LSVNPK | 9.8 | 329.2 | 544.31 | 19 |

TABLE 30-continued

| Transition number | Peptide | Retention time (minutes) | (m/z) filtered in Q1 | (m/z) filtered in Q3 | Collision energy (eV) |
|---|---|---|---|---|---|
| 799 | LTVGAR | 9.51 | 308.69 | 402.25 | 19 |
| 800 | LTVGAR | 9.51 | 308.69 | 442.27 | 19 |
| 801 | LTVGAR | 9.51 | 308.69 | 503.29 | 19 |
| 802 | LYGFALNIDMPGGEADIGK | 23.35 | 661 | 843.42 | 37 |
| 803 | LYGFALNIDMPGGEADIGK | 23.35 | 990.99 | 1089.49 | 49 |
| 804 | LYGFALNIDMPGGEADIGK | 23.35 | 990.99 | 1202.57 | 49 |
| 805 | LYHNELPFR | 15.29 | 396.88 | 414.21 | 24 |
| 806 | LYHNELPFR | 15.29 | 396.88 | 419.24 | 24 |
| 807 | LYHNELPFR | 15.29 | 396.88 | 657.3 | 24 |
| 808 | LYHNK | 8.54 | 337.68 | 414.21 | 20 |
| 809 | LYHNK | 8.53 | 337.68 | 528.26 | 20 |
| 810 | LYHNK | 8.53 | 337.68 | 561.28 | 20 |
| 811 | LYQNDLPFR | 17.2 | 583.3 | 761.39 | 31 |
| 812 | LYQNDLPFR | 17.2 | 583.3 | 889.45 | 31 |
| 813 | LYQNDLPFR | 17.2 | 583.3 | 1052.52 | 31 |
| 814 | MDDLFK | 15.5 | 384.68 | 522.29 | 22 |
| 815 | MDDLFK | 15.5 | 384.68 | 622.25 | 22 |
| 816 | MDDLFK | 15.5 | 384.68 | 637.32 | 22 |
| 817 | MEDLHK | 6.66 | 386.69 | 512.28 | 22 |
| 818 | MEDLHK | 6.65 | 386.69 | 626.26 | 22 |
| 819 | MEDLHK | 6.66 | 386.69 | 641.33 | 22 |
| 820 | MLIALIGLENHK | 21.33 | 451.26 | 527.26 | 27 |
| 821 | MLIALIGLENHK | 21.33 | 451.26 | 697.36 | 27 |
| 822 | MLIALIGLENHK | 21.33 | 451.26 | 810.45 | 27 |
| 823 | MLLIK | 15.81 | 309.21 | 373.28 | 19 |
| 824 | MLLIK | 15.81 | 309.21 | 471.3 | 19 |
| 825 | MLLIK | 15.81 | 309.21 | 486.36 | 19 |
| 826 | MLNALIGLEHHK | 16.89 | 459.26 | 550.27 | 27 |
| 827 | MLNALIGLEHHK | 16.89 | 459.26 | 720.38 | 27 |
| 828 | MLNALIGLEHHK | 16.89 | 459.26 | 833.46 | 27 |
| 829 | MLNALIGLENHK | 18.39 | 451.58 | 697.36 | 27 |
| 830 | MLNALIGLENHK | 18.38 | 676.87 | 697.36 | 35 |
| 831 | MLNALIGLENHK | 18.39 | 676.87 | 810.45 | 35 |
| 832 | MLNALIGLENQK | 19.71 | 672.37 | 688.36 | 35 |
| 833 | MLNALIGLENQK | 19.71 | 672.37 | 801.45 | 35 |
| 834 | MLNALIGLENQK | 19.71 | 672.37 | 914.53 | 35 |
| 835 | MLNALIGLEYHK | 19.6 | 701.38 | 746.38 | 36 |
| 836 | MLNALIGLEYHK | 19.6 | 701.38 | 859.47 | 36 |

TABLE 30-continued

| Transition number | Peptide | Retention time (minutes) | (m/z) filtered in Q1 | (m/z) filtered in Q3 | Collision energy (eV) |
|---|---|---|---|---|---|
| 837 | MLNALIGLEYHK | 19.6 | 701.38 | 1157.63 | 36 |
| 838 | MLNALIGLQHGK | 17.5 | 432.25 | 582.34 | 26 |
| 839 | MLNALIGLQHGK | 17.5 | 432.25 | 639.36 | 26 |
| 840 | MLNALIGLQHGK | 17.5 | 432.25 | 752.44 | 26 |
| 841 | MLNALISLEHHK | 17.2 | 352.2 | 359.17 | 21 |
| 842 | MLNALISLEHHK | 17.21 | 469.26 | 750.39 | 27 |
| 843 | MLNALISLEHHK | 17.2 | 469.26 | 863.47 | 27 |
| 844 | MQAYVDAFDYGNR | 17.56 | 775.34 | 957.41 | 39 |
| 845 | MQAYVDAFDYGNR | 17.56 | 775.34 | 1056.47 | 39 |
| 846 | MQAYVDAFDYGNR | 17.56 | 775.34 | 1219.54 | 39 |
| 847 | MQEGLNK | 8.68 | 410.21 | 560.3 | 23 |
| 848 | MQEGLNK | 8.66 | 410.21 | 673.3 | 23 |
| 849 | MQEGLNK | 8.68 | 410.21 | 688.36 | 23 |
| 850 | MSPASTYK | 9.49 | 442.71 | 569.29 | 24 |
| 851 | MSPASTYK | 9.49 | 442.71 | 666.35 | 24 |
| 852 | MSPASTYK | 9.49 | 442.71 | 753.38 | 24 |
| 853 | NEHDPVLPYR | 13.09 | 413.88 | 435.24 | 25 |
| 854 | NEHDPVLPYR | 13.09 | 620.31 | 744.44 | 32 |
| 855 | NEHDPVLPYR | 13.09 | 620.31 | 859.47 | 32 |
| 856 | NEHQIFK | 9.91 | 458.24 | 509.21 | 25 |
| 857 | NEHQIFK | 9.91 | 458.24 | 622.29 | 25 |
| 858 | NEHQIFK | 9.91 | 458.24 | 672.38 | 25 |
| 859 | NEHQVFK | 7.74 | 451.23 | 658.37 | 25 |
| 860 | NEHQVFK | 7.74 | 451.23 | 755.35 | 25 |
| 861 | NEHQVFK | 7.74 | 451.23 | 787.41 | 25 |
| 862 | NEITYK | 9.35 | 384.2 | 524.31 | 22 |
| 863 | NEITYK | 9.35 | 384.2 | 621.29 | 22 |
| 864 | NEITYK | 9.35 | 384.2 | 653.35 | 22 |
| 865 | NELLMK | 13.08 | 374.21 | 504.32 | 21 |
| 866 | NELLMK | 13.09 | 374.21 | 601.3 | 21 |
| 867 | NELLMK | 13.09 | 374.21 | 633.36 | 21 |
| 868 | NELPFR | 14.39 | 388.21 | 419.24 | 22 |
| 869 | NELPFR | 14.39 | 388.21 | 532.32 | 22 |
| 870 | NELPFR | 14.4 | 388.21 | 661.37 | 22 |
| 871 | NISSYGNNLVR | 14.36 | 618.82 | 835.44 | 32 |
| 872 | NISSYGNNLVR | 14.36 | 618.82 | 922.47 | 32 |
| 873 | NISSYGNNLVR | 14.36 | 618.82 | 1009.51 | 32 |
| 874 | NISTYGNNLTR | 13.1 | 626.82 | 674.36 | 33 |

TABLE 30-continued

| Transition number | Peptide | Retention time (minutes) | (m/z) filtered in Q1 | (m/z) filtered in Q3 | Collision energy (eV) |
|---|---|---|---|---|---|
| 875 | NISTYGNNLTR | 13.09 | 626.82 | 837.42 | 33 |
| 876 | NISTYGNNLTR | 13.1 | 626.82 | 1025.5 | 33 |
| 877 | NLFNEVHTTGVLVIR | 20.69 | 571.32 | 757.49 | 33 |
| 878 | NLFNEVHTTGVLVIR | 20.7 | 571.32 | 858.54 | 33 |
| 879 | NLFNEVHTTGVLVIR | 20.7 | 571.32 | 995.6 | 33 |
| 880 | NLSTYGNALAR | 14.34 | 590.31 | 764.4 | 31 |
| 881 | NLSTYGNALAR | 14.35 | 590.31 | 865.45 | 31 |
| 882 | NLSTYGNALAR | 14.35 | 590.31 | 952.48 | 31 |
| 883 | NMENLELFGK | 19.08 | 597.79 | 820.46 | 31 |
| 884 | NMENLELFGK | 19.08 | 597.79 | 949.5 | 31 |
| 885 | NMENLELFGK | 19.08 | 597.79 | 1080.54 | 31 |
| 886 | NMLLLEENNGYK | 16.71 | 719.36 | 853.37 | 37 |
| 887 | NMLLLEENNGYK | 16.69 | 719.36 | 966.45 | 37 |
| 888 | NMLLLEENNGYK | 16.68 | 719.36 | 1079.54 | 37 |
| 889 | NMLLLEESNGYK | 18.12 | 705.85 | 939.44 | 36 |
| 890 | NMLLLEESNGYK | 18.13 | 705.85 | 1052.53 | 36 |
| 891 | NMLLLEESNGYK | 18.11 | 705.85 | 1165.61 | 36 |
| 892 | NMLLLEK | 16.99 | 430.75 | 502.32 | 24 |
| 893 | NMLLLEK | 16.98 | 430.75 | 615.41 | 24 |
| 894 | NMLLLEK | 16.98 | 430.75 | 746.45 | 24 |
| 895 | NMTLGDAMK | 14.42 | 490.73 | 521.24 | 27 |
| 896 | NMTLGDAMK | 14.42 | 490.73 | 634.32 | 27 |
| 897 | NMTLGDAMK | 14.42 | 490.73 | 735.37 | 27 |
| 898 | NNGLTEAWLESSLK | 20.61 | 781.4 | 862.47 | 39 |
| 899 | NNGLTEAWLESSLK | 20.6 | 781.4 | 933.5 | 39 |
| 900 | NNGLTEAWLESSLK | 20.62 | 781.4 | 1163.59 | 39 |
| 901 | NQLPFK | 13.49 | 373.71 | 391.23 | 21 |
| 902 | NQLPFK | 13.49 | 373.71 | 504.32 | 21 |
| 903 | NQLPFK | 13.49 | 373.71 | 632.38 | 21 |
| 904 | NQLPFQVEHQR | 14.33 | 698.36 | 796.41 | 36 |
| 905 | NQLPFQVEHQR | 14.33 | 698.36 | 1040.53 | 36 |
| 906 | NQLPFQVEHQR | 14.33 | 698.36 | 1153.61 | 36 |
| 907 | NSAIENTIDNMYLQDLENSTK | 22.77 | 805.04 | 934.45 | 44 |
| 908 | NSAIENTIDNMYLQDLENSTK | 22.77 | 805.04 | 1047.53 | 44 |
| 909 | NSAIENTIDNMYLQDLENSTK | 22.77 | 805.04 | 1210.6 | 44 |
| 910 | NSAIENTIENMYLQDLDNSTK | 23.13 | 805.04 | 920.43 | 44 |
| 911 | NSAIENTIENMYLQDLDNSTK | 23.13 | 805.04 | 1033.52 | 44 |
| 912 | NSAIENTIENMYLQDLDNSTK | 23.14 | 805.04 | 1196.58 | 44 |

TABLE 30-continued

| Transition number | Peptide | Retention time (minutes) | (m/z) filtered in Q1 | (m/z) filtered in Q3 | Collision energy (eV) |
|---|---|---|---|---|---|
| 913 | NSAIENTIENMYLQDLENSTK | 23.7 | 809.72 | 934.45 | 44 |
| 914 | NSAIENTIENMYLQDLENSTK | 23.7 | 809.72 | 1047.53 | 44 |
| 915 | NSAIENTIENMYLQDLENSTK | 23.7 | 809.72 | 1217.55 | 44 |
| 916 | NSAVWVYELFAK | 24.66 | 713.87 | 869.48 | 36 |
| 917 | NSAVWVYELFAK | 24.66 | 713.87 | 1055.56 | 36 |
| 918 | NSAVWVYELFAK | 24.65 | 713.87 | 1154.62 | 36 |
| 919 | NSQVPAYK | 9.78 | 453.74 | 478.27 | 25 |
| 920 | NSQVPAYK | 9.78 | 453.74 | 577.33 | 25 |
| 921 | NSQVPAYK | 9.78 | 453.74 | 705.39 | 25 |
| 922 | NSTVWIYELFAK | 25.64 | 735.88 | 883.49 | 37 |
| 923 | NSTVWIYELFAK | 25.64 | 735.88 | 1069.57 | 37 |
| 924 | NSTVWIYELFAK | 25.64 | 735.88 | 1168.64 | 37 |
| 925 | NSTVWVYELFAK | 24.42 | 728.88 | 770.41 | 37 |
| 926 | NSTVWVYELFAK | 24.43 | 728.88 | 869.48 | 37 |
| 927 | NSTVWVYELFAK | 24.42 | 728.88 | 1055.56 | 37 |
| 928 | NSTVWVYQLFAK | 23.9 | 728.39 | 769.42 | 37 |
| 929 | NSTVWVYQLFAK | 23.91 | 728.39 | 1054.57 | 37 |
| 930 | NSTVWVYQLFAK | 23.91 | 728.39 | 1153.64 | 37 |
| 931 | NTSGALVIQTDK | 13.34 | 623.84 | 816.48 | 32 |
| 932 | NTSGALVIQTDK | 13.34 | 623.84 | 944.54 | 32 |
| 933 | NTSGALVIQTDK | 13.34 | 623.84 | 1031.57 | 32 |
| 934 | NTSGVLVIQTDK | 14.9 | 637.85 | 816.48 | 33 |
| 935 | NTSGVLVIQTDK | 14.9 | 637.85 | 972.57 | 33 |
| 936 | NTSGVLVIQTDK | 14.91 | 637.85 | 1059.6 | 33 |
| 937 | NVDEMFYYYDGSK | 18.86 | 815.84 | 895.38 | 41 |
| 938 | NVDEMFYYYDGSK | 18.86 | 815.84 | 1042.45 | 41 |
| 939 | NVDEMFYYYDGSK | 18.85 | 815.84 | 1173.49 | 41 |
| 940 | NWILR | 16.3 | 351.21 | 414.21 | 20 |
| 941 | NWILR | 16.29 | 351.21 | 527.3 | 20 |
| 942 | NWILR | 16.3 | 351.21 | 587.37 | 20 |
| 943 | NWNAAMDLR | 16.54 | 545.76 | 605.31 | 29 |
| 944 | NWNAAMDLR | 16.55 | 545.76 | 676.34 | 29 |
| 945 | NWNAAMDLR | 16.54 | 545.76 | 790.39 | 29 |
| 946 | NYVDAFHYGNQDISGDK | 15.76 | 648.29 | 933.43 | 36 |
| 947 | NYVDAFHYGNQDISGDK | 15.77 | 648.29 | 1096.49 | 36 |
| 948 | NYVDAFHYGNQDISGDK | 15.76 | 971.93 | 1233.55 | 48 |
| 949 | QADHAILVFDQAR | 16.58 | 495.26 | 523.23 | 29 |
| 950 | QADHAILVFDQAR | 16.61 | 495.26 | 636.31 | 29 |

TABLE 30-continued

| Transition number | Peptide | Retention time (minutes) | (m/z) filtered in Q1 | (m/z) filtered in Q3 | Collision energy (eV) |
|---|---|---|---|---|---|
| 951 | QADHAILVFDQAR | 16.58 | 495.26 | 735.38 | 29 |
| 952 | QAEHALLVFGQER | 16.86 | 499.93 | 636.31 | 29 |
| 953 | QAEHALLVFGQER | 16.85 | 499.93 | 735.38 | 29 |
| 954 | QAEHALLVFGQER | 16.87 | 499.93 | 763.41 | 29 |
| 955 | QAITK | 11 | 280.67 | 361.24 | 17 |
| 956 | QAITK | 11 | 280.67 | 414.23 | 17 |
| 957 | QAITK | 11.01 | 280.67 | 432.28 | 17 |
| 958 | QAMLTEANSDYIIR | 18.26 | 812.9 | 951.49 | 41 |
| 959 | QAMLTEANSDYIIR | 18.25 | 812.9 | 1080.53 | 41 |
| 960 | QAMLTEANSDYIIR | 18.26 | 812.9 | 1181.58 | 41 |
| 961 | QEVQFVSALAR | 17.69 | 624.34 | 763.45 | 32 |
| 962 | QEVQFVSALAR | 17.68 | 624.34 | 891.5 | 32 |
| 963 | QEVQFVSALAR | 17.68 | 624.34 | 990.57 | 32 |
| 964 | QFASIK | 11.66 | 347.2 | 434.2 | 20 |
| 965 | QFASIK | 11.66 | 347.2 | 547.29 | 20 |
| 966 | QFASIK | 11.68 | 347.2 | 565.33 | 20 |
| 967 | QGMPGSIR | 11.4 | 423.22 | 529.31 | 24 |
| 968 | QGMPGSIR | 11.43 | 423.22 | 660.35 | 24 |
| 969 | QGMPGSIR | 11.4 | 423.22 | 717.37 | 24 |
| 970 | QGMSGSIR | 9.44 | 418.21 | 519.29 | 23 |
| 971 | QGMSGSIR | 9.45 | 418.21 | 650.33 | 23 |
| 972 | QGMSGSIR | 9.44 | 418.21 | 707.35 | 23 |
| 973 | QGQTQQSYGNDLAR | 11.16 | 783.37 | 895.43 | 39 |
| 974 | QGQTQQSYGNDLAR | 11.17 | 783.37 | 1023.49 | 39 |
| 975 | QGQTQQSYGNDLAR | 11.16 | 783.37 | 1151.54 | 39 |
| 976 | QIDYGNADPSTIK | 13.41 | 711.35 | 845.44 | 36 |
| 977 | QIDYGNADPSTIK | 13.42 | 711.35 | 902.46 | 36 |
| 978 | QIDYGNADPSTIK | 13.42 | 711.35 | 1065.52 | 36 |
| 979 | QIDYGNVDPSTIK | 15.08 | 725.36 | 873.47 | 37 |
| 980 | QIDYGNVDPSTIK | 15.07 | 725.36 | 930.49 | 37 |
| 981 | QIDYGNVDPSTIK | 15.07 | 725.36 | 1093.55 | 37 |
| 982 | QIGQAR | 2.3 | 336.69 | 431.24 | 20 |
| 983 | QIGQAR | 2.33 | 336.69 | 498.27 | 20 |
| 984 | QIGQAR | 2.32 | 336.69 | 544.32 | 20 |
| 985 | QIMLIEQTPAFTLR | 24.42 | 830.96 | 933.52 | 42 |
| 986 | QIMLIEQTPAFTLR | 24.42 | 830.96 | 1062.56 | 42 |
| 987 | QIMLIEQTPAFTLR | 24.42 | 830.96 | 1175.64 | 42 |
| 988 | QLGSAIDQFWLR | 22.67 | 717.38 | 864.44 | 37 |

TABLE 30-continued

| Transition number | Peptide | Retention time (minutes) | (m/z) filtered in Q1 | (m/z) filtered in Q3 | Collision energy (eV) |
| --- | --- | --- | --- | --- | --- |
| 989 | QLGSAIDQFWLR | 22.68 | 717.38 | 977.52 | 37 |
| 990 | QLGSAIDQFWLR | 22.67 | 717.38 | 1192.61 | 37 |
| 991 | QLPVK | 9.57 | 292.69 | 343.23 | 18 |
| 992 | QLPVK | 9.58 | 292.69 | 438.27 | 18 |
| 993 | QLPVK | 9.57 | 292.69 | 456.32 | 18 |
| 994 | QLSLDVLDK | 18.63 | 515.79 | 589.32 | 28 |
| 995 | QLSLDVLDK | 18.62 | 515.79 | 789.44 | 28 |
| 996 | QLSLDVLDK | 18.63 | 515.79 | 902.52 | 28 |
| 997 | QLVYAR | 11.04 | 375.22 | 508.29 | 22 |
| 998 | QLVYAR | 11.04 | 375.22 | 575.32 | 22 |
| 999 | QLVYAR | 11.04 | 375.22 | 621.37 | 22 |
| 1000 | QMMLTEASTDYIIR | 19.82 | 836.41 | 867.46 | 42 |
| 1001 | QMMLTEASTDYIIR | 19.82 | 836.41 | 1067.54 | 42 |
| 1002 | QMMLTEASTDYIIR | 19.82 | 836.41 | 1168.58 | 42 |
| 1003 | QMSIVEATPDYVLHGK | 18.77 | 894.45 | 1029.54 | 44 |
| 1004 | QMSIVEATPDYVLHGK | 18.77 | 894.45 | 1100.57 | 44 |
| 1005 | QMSIVEATPDYVLHGK | 18.77 | 894.45 | 1229.62 | 44 |
| 1006 | QTLVFAR | 14.65 | 417.75 | 492.29 | 23 |
| 1007 | QTLVFAR | 14.65 | 417.75 | 605.38 | 23 |
| 1008 | QTLVFAR | 14.65 | 417.75 | 706.42 | 23 |
| 1009 | QVVFAR | 12.06 | 360.21 | 492.29 | 21 |
| 1010 | QVVFAR | 12.04 | 360.21 | 545.31 | 21 |
| 1011 | QVVFAR | 12.06 | 360.21 | 591.36 | 21 |
| 1012 | SADEVLPYGGKPQR | 12.96 | 506.26 | 642.37 | 29 |
| 1013 | SADEVLPYGGKPQR | 12.96 | 506.26 | 805.43 | 29 |
| 1014 | SADEVLPYGGKPQR | 12.96 | 506.26 | 902.48 | 29 |
| 1015 | SC[CAM]ATNDLAR | 9.37 | 504.23 | 689.36 | 27 |
| 1016 | SC[CAM]ATNDLAR | 9.37 | 504.23 | 760.39 | 27 |
| 1017 | SC[CAM]ATNDLAR | 9.37 | 504.23 | 920.43 | 27 |
| 1018 | SC[CAM]ATNNLAR | 8.66 | 503.74 | 688.37 | 27 |
| 1019 | SC[CAM]ATNNLAR | 8.66 | 503.74 | 759.41 | 27 |
| 1020 | SC[CAM]ATNNLAR | 8.67 | 503.74 | 919.44 | 27 |
| 1021 | SDIPGGSK | 7.63 | 380.7 | 558.32 | 22 |
| 1022 | SDIPGGSK | 7.63 | 380.7 | 614.28 | 22 |
| 1023 | SDIPGGSK | 7.63 | 380.7 | 673.35 | 22 |
| 1024 | SDWGK | 5.75 | 296.64 | 390.21 | 18 |
| 1025 | SDWGK | 5.75 | 296.64 | 446.17 | 18 |
| 1026 | SDWGK | 5.75 | 296.64 | 505.24 | 18 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1027 | SEDNFHISSQQHEK | 10.36 | 422.19 | 541.27 | 24 |
| 1028 | SEDNFHISSQQHEK | 10.36 | 422.19 | 730.28 | 24 |
| 1029 | SEDNFHISSQQHEK | 10.36 | 422.19 | 756.36 | 24 |
| 1030 | SEMPASIR | 12.02 | 445.72 | 674.37 | 25 |
| 1031 | SEMPASIR | 12.02 | 445.72 | 716.33 | 25 |
| 1032 | SEMPASIR | 12.02 | 445.72 | 803.41 | 25 |
| 1033 | SEMPASTR | 8.2 | 439.71 | 662.33 | 24 |
| 1034 | SEMPASTR | 8.19 | 439.71 | 704.29 | 24 |
| 1035 | SEMPASTR | 8.19 | 439.71 | 791.37 | 24 |
| 1036 | SFAAHNQDQDLR | 10.35 | 467.89 | 531.29 | 27 |
| 1037 | SFAAHNQDQDLR | 10.35 | 467.89 | 871.37 | 27 |
| 1038 | SFAAHNQDQDLR | 10.35 | 467.89 | 888.42 | 27 |
| 1039 | SFAGHNK | 9.4 | 380.69 | 455.24 | 22 |
| 1040 | SFAGHNK | 9.4 | 380.69 | 526.27 | 22 |
| 1041 | SFAGHNK | 9.38 | 380.69 | 673.34 | 22 |
| 1042 | SFAGHNQDQDLR | 10.18 | 694.32 | 888.42 | 36 |
| 1043 | SFAGHNQDQDLR | 10.18 | 694.32 | 1025.48 | 36 |
| 1044 | SFAGHNQDQDLR | 10.18 | 694.32 | 1082.5 | 36 |
| 1045 | SFAGHNQDQNLR | 9.8 | 462.89 | 530.3 | 27 |
| 1046 | SFAGHNQDQNLR | 9.8 | 462.89 | 773.39 | 27 |
| 1047 | SFAGHNQDQNLR | 9.8 | 462.89 | 887.43 | 27 |
| 1048 | SFLESWAK | 18.27 | 484.25 | 491.26 | 26 |
| 1049 | SFLESWAK | 18.27 | 484.25 | 620.3 | 26 |
| 1050 | SFLESWAK | 18.27 | 484.25 | 733.39 | 26 |
| 1051 | SFTAWEK | 14.44 | 434.71 | 462.23 | 24 |
| 1052 | SFTAWEK | 14.44 | 434.71 | 533.27 | 24 |
| 1053 | SFTAWEK | 14.44 | 434.71 | 634.32 | 24 |
| 1054 | SFTTWEK | 14.1 | 449.72 | 462.23 | 25 |
| 1055 | SFTTWEK | 14.1 | 449.72 | 563.28 | 25 |
| 1056 | SFTTWEK | 14.1 | 449.72 | 664.33 | 25 |
| 1057 | SGSGWLR | 13.25 | 381.7 | 531.3 | 22 |
| 1058 | SGSGWLR | 13.25 | 381.7 | 618.34 | 22 |
| 1059 | SGSGWLR | 13.25 | 381.7 | 675.36 | 22 |
| 1060 | SGWGMAVDPQVGWYVGFVEK | 24.65 | 738.02 | 841.45 | 41 |
| 1061 | SGWGMAVDPQVGWYVGFVEK | 24.65 | 738.02 | 1029.45 | 41 |
| 1062 | SGWGMAVDPQVGWYVGFVEK | 24.68 | 1106.53 | 1128.51 | 54 |
| 1063 | SGWGMDVSPQVGWLTGWVEK | 26.32 | 1110.03 | 1144.51 | 54 |
| 1064 | SGWGMDVSPQVGWLTGWVEK | 26.32 | 1110.03 | 1174.63 | 54 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1065 | SGWGMDVSPQVGWLTGWVEK | 26.32 | 1110.03 | 1201.53 | 54 |
| 1066 | SGWGMDVTPQVGWLTGWVEK | 26.61 | 745.03 | 832.46 | 41 |
| 1067 | SGWGMDVTPQVGWLTGWVEK | 26.61 | 745.03 | 1018.54 | 41 |
| 1068 | SGWGMDVTPQVGWLTGWVEK | 26.61 | 745.03 | 1075.56 | 41 |
| 1069 | SIHPASTFK | 10.74 | 494.27 | 650.35 | 27 |
| 1070 | SIHPASTFK | 10.73 | 494.27 | 787.41 | 27 |
| 1071 | SIHPASTFK | 10.73 | 494.27 | 900.49 | 27 |
| 1072 | SISTK | 10.41 | 268.16 | 335.19 | 17 |
| 1073 | SISTK | 10.42 | 268.16 | 389.2 | 17 |
| 1074 | SISTK | 10.42 | 268.16 | 448.28 | 17 |
| 1075 | SLGLSNNLSR | 14.23 | 530.79 | 690.35 | 28 |
| 1076 | SLGLSNNLSR | 14.23 | 530.79 | 803.44 | 28 |
| 1077 | SLGLSNNLSR | 14.23 | 530.79 | 860.46 | 28 |
| 1078 | SLSMSGK | 9.31 | 355.18 | 509.24 | 21 |
| 1079 | SLSMSGK | 9.32 | 355.18 | 563.25 | 21 |
| 1080 | SLSMSGK | 9.32 | 355.18 | 622.32 | 21 |
| 1081 | SMLFIEEK | 17.82 | 498.76 | 518.28 | 27 |
| 1082 | SMLFIEEK | 17.82 | 498.76 | 665.35 | 27 |
| 1083 | SMLFIEEK | 17.82 | 498.76 | 778.43 | 27 |
| 1084 | SNGLTHSWLGSSLK | 16.78 | 743.89 | 877.48 | 38 |
| 1085 | SNGLTHSWLGSSLK | 16.78 | 743.89 | 1014.54 | 38 |
| 1086 | SNGLTHSWLGSSLK | 16.78 | 743.89 | 1115.58 | 38 |
| 1087 | SPTWELKPEYNPSPR | 16.02 | 600.97 | 733.36 | 34 |
| 1088 | SPTWELKPEYNPSPR | 16.02 | 600.97 | 808.91 | 34 |
| 1089 | SPTWELKPEYNPSPR | 16.02 | 600.97 | 959.46 | 34 |
| 1090 | SQDIVR | 8.4 | 359.2 | 502.3 | 21 |
| 1091 | SQDIVR | 8.38 | 359.2 | 543.28 | 21 |
| 1092 | SQDIVR | 8.4 | 359.2 | 630.36 | 21 |
| 1093 | SQQKPTDPTIWLK | 16.6 | 514.62 | 660.41 | 30 |
| 1094 | SQQKPTDPTIWLK | 16.6 | 514.62 | 757.46 | 30 |
| 1095 | SQQKPTDPTIWLK | 16.6 | 514.62 | 785.38 | 30 |
| 1096 | SQVGWLTGWVEQPDGK | 22.27 | 893.94 | 1015.5 | 44 |
| 1097 | SQVGWLTGWVEQPDGK | 22.28 | 893.94 | 1116.53 | 44 |
| 1098 | SQVGWLTGWVEQPDGK | 22.28 | 893.94 | 1229.62 | 44 |
| 1099 | SSSNSC[CAM]TTNNAAR | 16.84 | 685.29 | 907.41 | 35 |
| 1100 | SSSNSC[CAM]TTNNAAR | 16.85 | 685.29 | 994.44 | 35 |
| 1101 | SSSNSC[CAM]TTNNAAR | 16.84 | 685.29 | 1108.48 | 35 |
| 1102 | SVYGELR | 12.65 | 412.22 | 417.25 | 23 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1103 | SVYGELR | 12.65 | 412.22 | 474.27 | 23 |
| 1104 | SVYGELR | 12.65 | 412.22 | 637.33 | 23 |
| 1105 | SWILR | 16.33 | 337.7 | 401.29 | 20 |
| 1106 | SWILR | 16.32 | 337.7 | 500.29 | 20 |
| 1107 | SWILR | 16.33 | 337.7 | 587.37 | 20 |
| 1108 | SYLEK | 9.09 | 320.17 | 389.24 | 19 |
| 1109 | SYLEK | 9.09 | 320.17 | 493.23 | 19 |
| 1110 | SYLEK | 9.1 | 320.17 | 552.3 | 19 |
| 1111 | TAYIPASTFK | 15.43 | 549.8 | 650.35 | 29 |
| 1112 | TAYIPASTFK | 15.43 | 549.8 | 763.43 | 29 |
| 1113 | TAYIPASTFK | 15.43 | 549.8 | 926.5 | 29 |
| 1114 | TDDLFK | 13.48 | 369.69 | 407.27 | 21 |
| 1115 | TDDLFK | 13.48 | 369.69 | 522.29 | 21 |
| 1116 | TDDLFK | 13.48 | 369.69 | 637.32 | 21 |
| 1117 | TDINEIFK | 17.44 | 490.26 | 650.35 | 27 |
| 1118 | TDINEIFK | 17.44 | 490.26 | 763.43 | 27 |
| 1119 | TDINEIFK | 17.44 | 490.26 | 878.46 | 27 |
| 1120 | TFIHNDPR | 18.92 | 500.25 | 751.38 | 27 |
| 1121 | TFIHNDPR | 18.92 | 500.25 | 825.39 | 27 |
| 1122 | TFIHNDPR | 18.92 | 500.25 | 898.45 | 27 |
| 1123 | TGAGFTANR | 9.64 | 447.72 | 461.25 | 25 |
| 1124 | TGAGFTANR | 9.64 | 447.72 | 665.34 | 25 |
| 1125 | TGAGFTANR | 9.64 | 447.72 | 793.4 | 25 |
| 1126 | TGFNDGQK | 7.5 | 433.7 | 561.26 | 24 |
| 1127 | TGFNDGQK | 7.5 | 433.7 | 708.33 | 24 |
| 1128 | TGFNDGQK | 7.5 | 433.7 | 765.35 | 24 |
| 1129 | TGLADSK | 9.7 | 346.18 | 533.29 | 20 |
| 1130 | TGLADSK | 9.67 | 346.18 | 545.26 | 20 |
| 1131 | TGLADSK | 9.7 | 346.18 | 590.31 | 20 |
| 1132 | TGLDLMQK | 15.32 | 453.24 | 634.32 | 25 |
| 1133 | TGLDLMQK | 15.32 | 453.24 | 747.41 | 25 |
| 1134 | TGLDLMQK | 15.32 | 453.24 | 804.43 | 25 |
| 1135 | TGLELMQK | 15.03 | 460.25 | 648.34 | 25 |
| 1136 | TGLELMQK | 15.03 | 460.25 | 761.42 | 25 |
| 1137 | TGLELMQK | 15.03 | 460.25 | 818.44 | 25 |
| 1138 | TGMGYPK | 10.28 | 377.18 | 464.25 | 22 |
| 1139 | TGMGYPK | 10.28 | 377.18 | 595.29 | 22 |
| 1140 | TGMGYPK | 10.28 | 377.18 | 652.31 | 22 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1141 | TGNGR | 0.8 | 252.63 | 330.14 | 16 |
| 1142 | TGNGR | 0.8 | 252.63 | 346.18 | 16 |
| 1143 | TGNGR | 0.81 | 252.63 | 403.2 | 16 |
| 1144 | TGTGSFIDAR | 13.35 | 512.76 | 708.37 | 28 |
| 1145 | TGTGSFIDAR | 13.35 | 512.76 | 765.39 | 28 |
| 1146 | TGTGSFIDAR | 13.35 | 512.76 | 866.44 | 28 |
| 1147 | TGTGSLSDAK | 8.32 | 468.74 | 620.32 | 26 |
| 1148 | TGTGSLSDAK | 8.32 | 468.74 | 677.35 | 26 |
| 1149 | TGTGSLSDAK | 8.32 | 468.74 | 778.39 | 26 |
| 1150 | TGVATEYQPEIGWWAGWVER | 25.49 | 779.04 | 903.45 | 43 |
| 1151 | TGVATEYQPEIGWWAGWVER | 25.5 | 779.04 | 1146.55 | 43 |
| 1152 | TGVATEYQPEIGWWAGWVER | 25.52 | 1168.06 | 1189.57 | 56 |
| 1153 | TGVSYPLLADGTR | 17.4 | 675.36 | 842.47 | 35 |
| 1154 | TGVSYPLLADGTR | 17.41 | 675.36 | 1005.54 | 35 |
| 1155 | TGVSYPLLADGTR | 17.4 | 675.36 | 1092.57 | 35 |
| 1156 | TGWAMDIK | 16.71 | 461.23 | 577.3 | 25 |
| 1157 | TGWAMDIK | 16.71 | 461.23 | 763.38 | 25 |
| 1158 | TGWAMDIK | 16.72 | 461.23 | 820.4 | 25 |
| 1159 | TGWATR | 9.71 | 346.18 | 517.24 | 20 |
| 1160 | TGWATR | 9.69 | 346.18 | 533.28 | 20 |
| 1161 | TGWATR | 9.69 | 346.18 | 590.3 | 20 |
| 1162 | TGWC[CAM]FDC[CAM]TPELGWWVGWVK | 28.39 | 795.36 | 960.51 | 44 |
| 1163 | TGWC[CAM]FDC[CAM]TPELGWWVGWVK | 28.39 | 795.36 | 1017.53 | 44 |
| 1164 | TGWC[CAM]FDC[CAM]TPELGWWVGWVK | 28.38 | 795.36 | 1028.36 | 44 |
| 1165 | TGWEGR | 9.1 | 353.17 | 531.22 | 21 |
| 1166 | TGWEGR | 9.09 | 353.17 | 547.26 | 21 |
| 1167 | TGWEGR | 9.09 | 353.17 | 604.28 | 21 |
| 1168 | TGWFVDK | 16.08 | 426.72 | 694.36 | 24 |
| 1169 | TGWFVDK | 16.1 | 426.72 | 706.32 | 24 |
| 1170 | TGWFVDK | 16.08 | 426.72 | 751.38 | 24 |
| 1171 | TGYDTK | 2.09 | 342.66 | 526.25 | 20 |
| 1172 | TGYDTK | 2.09 | 342.66 | 538.21 | 20 |
| 1173 | TGYDTK | 2.08 | 342.66 | 583.27 | 20 |
| 1174 | TGYGVR | 8.09 | 326.67 | 478.23 | 19 |
| 1175 | TGYGVR | 8.1 | 326.67 | 494.27 | 19 |
| 1176 | TGYGVR | 8.1 | 326.67 | 551.29 | 19 |
| 1177 | TGYSAR | 2.24 | 327.66 | 480.21 | 19 |
| 1178 | TGYSAR | 2.24 | 327.66 | 496.25 | 19 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1179 | TGYSAR | 2.24 | 327.66 | 553.27 | 19 |
| 1180 | TGYSTR | 2.08 | 342.67 | 510.22 | 20 |
| 1181 | TGYSTR | 2.08 | 342.67 | 526.26 | 20 |
| 1182 | TGYSTR | 2.08 | 342.67 | 583.28 | 20 |
| 1183 | THESSNWGK | 5.36 | 523.24 | 678.32 | 28 |
| 1184 | THESSNWGK | 5.37 | 523.24 | 807.36 | 28 |
| 1185 | THESSNWGK | 5.37 | 523.24 | 944.42 | 28 |
| 1186 | TIC[CAM]TAIADAGTGK | 14.35 | 639.82 | 732.39 | 33 |
| 1187 | TIC[CAM]TAIADAGTGK | 14.35 | 639.82 | 904.47 | 33 |
| 1188 | TIC[CAM]TAIADAGTGK | 14.35 | 639.82 | 1064.5 | 33 |
| 1189 | TIGGAPDAYWVDDSLQISAR | 21.22 | 712.35 | 1004.5 | 40 |
| 1190 | TIGGAPDAYWVDDSLQISAR | 21.22 | 712.35 | 1103.57 | 40 |
| 1191 | TIGGAPDAYWVDDSLQISAR | 21.21 | 1068.02 | 1103.57 | 52 |
| 1192 | TLPFSASSYETLR | 18.73 | 736.37 | 855.42 | 37 |
| 1193 | TLPFSASSYETLR | 18.73 | 736.37 | 1013.49 | 37 |
| 1194 | TLPFSASSYETLR | 18.73 | 736.37 | 1160.56 | 37 |
| 1195 | TLPFSPK | 15 | 395.23 | 478.27 | 22 |
| 1196 | TLPFSPK | 15 | 395.23 | 575.32 | 22 |
| 1197 | TLPFSPK | 15 | 395.23 | 688.4 | 22 |
| 1198 | TLPFSQEVQDEVQSILFIEEK | 28.55 | 827.09 | 891.52 | 45 |
| 1199 | TLPFSQEVQDEVQSILFIEEK | 28.56 | 827.09 | 978.55 | 45 |
| 1200 | TLPFSQEVQDEVQSILFIEEK | 28.56 | 827.09 | 1106.61 | 45 |
| 1201 | TLPFSQEVQDEVQSMLFIEEK | 27.7 | 833.08 | 996.51 | 46 |
| 1202 | TLPFSQEVQDEVQSMLFIEEK | 27.69 | 833.08 | 1124.57 | 46 |
| 1203 | TLPFSQEVQDEVQSMLFIEEK | 27.7 | 833.08 | 1223.63 | 46 |
| 1204 | TLQNGWFEGFIISK | 24.12 | 820.43 | 940.51 | 41 |
| 1205 | TLQNGWFEGFIISK | 24.11 | 820.43 | 1126.59 | 41 |
| 1206 | TLQNGWFEGFIISK | 24.11 | 820.43 | 1183.61 | 41 |
| 1207 | TMQEYLNK | 12.6 | 513.75 | 666.35 | 28 |
| 1208 | TMQEYLNK | 12.6 | 513.75 | 794.4 | 28 |
| 1209 | TMQEYLNK | 12.6 | 513.75 | 925.44 | 28 |
| 1210 | TQTYQAYDAAR | 11.2 | 644.3 | 666.32 | 33 |
| 1211 | TQTYQAYDAAR | 11.2 | 644.3 | 957.44 | 33 |
| 1212 | TQTYQAYDAAR | 11.2 | 644.3 | 1058.49 | 33 |
| 1213 | TTDPTIWEK | 14.39 | 545.77 | 676.37 | 29 |
| 1214 | TTDPTIWEK | 14.39 | 545.77 | 773.42 | 29 |
| 1215 | TTDPTIWEK | 14.39 | 545.77 | 888.45 | 29 |
| 1216 | TTTTEVFK | 12.06 | 463.75 | 522.29 | 25 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1217 | TTTTEVFK | 12.06 | 463.75 | 623.34 | 25 |
| 1218 | TTTTEVFK | 12.06 | 463.75 | 724.39 | 25 |
| 1219 | TWASNDFSR | 13.73 | 542.25 | 638.29 | 29 |
| 1220 | TWASNDFSR | 13.73 | 542.25 | 725.32 | 29 |
| 1221 | TWASNDFSR | 13.73 | 542.25 | 796.36 | 29 |
| 1222 | TWDMVQR | 14.28 | 468.22 | 648.31 | 26 |
| 1223 | TWDMVQR | 14.28 | 468.22 | 761.33 | 26 |
| 1224 | TWDMVQR | 14.28 | 468.22 | 834.39 | 26 |
| 1225 | TYVVDPAR | 12.15 | 460.75 | 557.3 | 25 |
| 1226 | TYVVDPAR | 12.14 | 460.75 | 656.37 | 25 |
| 1227 | TYVVDPAR | 12.15 | 460.75 | 819.44 | 25 |
| 1228 | VAFSLNIEMK | 20.65 | 576.31 | 747.41 | 30 |
| 1229 | VAFSLNIEMK | 20.65 | 576.31 | 834.44 | 30 |
| 1230 | VAFSLNIEMK | 20.65 | 576.31 | 981.51 | 30 |
| 1231 | VANSLIGLSTGAVR | 17.97 | 679.39 | 760.43 | 35 |
| 1232 | VANSLIGLSTGAVR | 17.97 | 679.39 | 873.52 | 35 |
| 1233 | VANSLIGLSTGAVR | 17.97 | 679.39 | 986.6 | 35 |
| 1234 | VELGK | 7.74 | 273.17 | 342.2 | 17 |
| 1235 | VELGK | 7.75 | 273.17 | 399.22 | 17 |
| 1236 | VELGK | 7.74 | 273.17 | 446.26 | 17 |
| 1237 | VFLDSWAK | 18.2 | 483.26 | 606.29 | 26 |
| 1238 | VFLDSWAK | 18.2 | 483.26 | 719.37 | 26 |
| 1239 | VFLDSWAK | 18.2 | 483.26 | 866.44 | 26 |
| 1240 | VFLESWAK | 18.11 | 490.27 | 620.3 | 27 |
| 1241 | VFLESWAK | 18.11 | 490.27 | 733.39 | 27 |
| 1242 | VFLESWAK | 18.11 | 490.27 | 880.46 | 27 |
| 1243 | VFLSSWAQDMNLSSAIK | 23.66 | 948.98 | 978.49 | 47 |
| 1244 | VFLSSWAQDMNLSSAIK | 23.66 | 948.98 | 1106.55 | 47 |
| 1245 | VFLSSWAQDMNLSSAIK | 23.66 | 948.98 | 1177.59 | 47 |
| 1246 | VGFER | 10.32 | 304.16 | 433.21 | 18 |
| 1247 | VGFER | 10.32 | 304.16 | 451.23 | 18 |
| 1248 | VGFER | 10.32 | 304.16 | 508.25 | 18 |
| 1249 | VILVFDQVR | 19.69 | 544.83 | 664.34 | 29 |
| 1250 | VILVFDQVR | 19.69 | 544.83 | 763.41 | 29 |
| 1251 | VILVFDQVR | 19.69 | 544.83 | 876.49 | 29 |
| 1252 | VMAAMVR | 12.3 | 389.21 | 476.26 | 22 |
| 1253 | VMAAMVR | 12.3 | 389.21 | 547.3 | 22 |
| 1254 | VMAAMVR | 12.3 | 389.21 | 678.34 | 22 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1255 | VPLAVMGYDAGILVDAHNPR | 21.61 | 703.37 | 709.34 | 39 |
| 1256 | VPLAVMGYDAGILVDAHNPR | 21.61 | 703.37 | 808.41 | 39 |
| 1257 | VPLAVMGYDAGILVDAHNPR | 21.61 | 703.37 | 921.49 | 39 |
| 1258 | VQDEVQSMLFIEEK | 20.48 | 847.92 | 996.51 | 42 |
| 1259 | VQDEVQSMLFIEEK | 20.48 | 847.92 | 1124.57 | 42 |
| 1260 | VQDEVQSMLFIEEK | 20.47 | 847.92 | 1223.63 | 42 |
| 1261 | VQDGVQSMLFIEEK | 20.26 | 811.91 | 996.51 | 41 |
| 1262 | VQDGVQSMLFIEEK | 20.27 | 811.91 | 1124.57 | 41 |
| 1263 | VQDGVQSMLFIEEK | 20.25 | 811.91 | 1223.63 | 41 |
| 1264 | VSC[CAM]LPC[CAM]YQVVSHK | 14.32 | 526.26 | 569.34 | 30 |
| 1265 | VSC[CAM]LPC[CAM]YQVVSHK | 14.32 | 526.26 | 860.46 | 30 |
| 1266 | VSC[CAM]LPC[CAM]YQVVSHK | 14.31 | 526.26 | 1020.49 | 30 |
| 1267 | VSC[CAM]VWC[CAM]YQALAR | 18.41 | 756.86 | 881.43 | 38 |
| 1268 | VSC[CAM]VWC[CAM]YQALAR | 18.41 | 756.86 | 1067.51 | 38 |
| 1269 | VSC[CAM]VWC[CAM]YQALAR | 18.41 | 756.86 | 1166.58 | 38 |
| 1270 | VSDVC[CAM]SEVTAEGWQEVR | 17.33 | 650.97 | 774.39 | 37 |
| 1271 | VSDVC[CAM]SEVTAEGWQEVR | 17.34 | 975.95 | 1075.52 | 48 |
| 1272 | VSDVC[CAM]SEVTAEGWQEVR | 17.34 | 975.95 | 1174.59 | 48 |
| 1273 | VSEVEGWQIHGK | 13.92 | 456.9 | 582.34 | 27 |
| 1274 | VSEVEGWQIHGK | 13.92 | 456.9 | 768.42 | 27 |
| 1275 | VSEVEGWQIHGK | 13.92 | 456.9 | 825.44 | 27 |
| 1276 | VSFSLNIEMK | 20.65 | 584.31 | 834.44 | 31 |
| 1277 | VSFSLNIEMK | 20.64 | 584.31 | 981.51 | 31 |
| 1278 | VSFSLNIEMK | 20.65 | 584.31 | 1068.54 | 31 |
| 1279 | VSPC[CAM]SSFK | 11.04 | 456.22 | 468.25 | 25 |
| 1280 | VSPC[CAM]SSFK | 11.04 | 456.22 | 628.28 | 25 |
| 1281 | VSPC[CAM]SSFK | 11.04 | 456.22 | 725.33 | 25 |
| 1282 | VSQVPAYK | 10.68 | 446.25 | 478.27 | 25 |
| 1283 | VSQVPAYK | 10.68 | 446.25 | 577.33 | 25 |
| 1284 | VSQVPAYK | 10.68 | 446.25 | 705.39 | 25 |
| 1285 | VVFAR | 11.17 | 296.18 | 393.22 | 18 |
| 1286 | VVFAR | 11.17 | 296.18 | 417.25 | 18 |
| 1287 | VVFAR | 11.17 | 296.18 | 492.29 | 18 |
| 1288 | WDGAK | 4.9 | 288.64 | 302.11 | 18 |
| 1289 | WDGAK | 4.9 | 288.64 | 390.2 | 18 |
| 1290 | WDGAK | 4.9 | 288.64 | 430.17 | 18 |
| 1291 | WDGHIYDFPDWNR | 20.52 | 574.25 | 590.27 | 33 |
| 1292 | WDGHIYDFPDWNR | 20.52 | 574.25 | 687.32 | 33 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1293 | WDGHIYDFPDWNR | 20.52 | 574.25 | 887.37 | 33 |
| 1294 | WDGIK | 12.03 | 309.67 | 359.13 | 19 |
| 1295 | WDGIK | 12.03 | 309.67 | 432.25 | 19 |
| 1296 | WDGIK | 12.03 | 309.67 | 472.22 | 19 |
| 1297 | WDGKPR | 6.36 | 379.7 | 457.29 | 22 |
| 1298 | WDGKPR | 6.35 | 379.7 | 572.32 | 22 |
| 1299 | WDGKPR | 6.36 | 379.7 | 584.28 | 22 |
| 1300 | WDGQTR | 7.41 | 381.68 | 461.25 | 22 |
| 1301 | WDGQTR | 7.41 | 381.68 | 576.27 | 22 |
| 1302 | WDGQTR | 7.41 | 381.68 | 588.24 | 22 |
| 1303 | WDGVK | 10.1 | 302.66 | 359.13 | 18 |
| 1304 | WDGVK | 10.1 | 302.66 | 418.23 | 18 |
| 1305 | WDGVK | 10.1 | 302.66 | 458.2 | 18 |
| 1306 | WDGVNR | 10.39 | 373.68 | 445.25 | 21 |
| 1307 | WDGVNR | 10.39 | 373.68 | 560.28 | 21 |
| 1308 | WDGVNR | 10.42 | 373.68 | 572.25 | 21 |
| 1309 | YAQAK | 12.58 | 290.66 | 363.17 | 18 |
| 1310 | YAQAK | 12.58 | 290.66 | 417.25 | 18 |
| 1311 | YAQAK | 12.58 | 290.66 | 434.2 | 18 |
| 1312 | YFSDFNAK | 14.21 | 496.23 | 681.32 | 27 |
| 1313 | YFSDFNAK | 14.21 | 496.23 | 828.39 | 27 |
| 1314 | YFSDFNAK | 14.21 | 496.23 | 828.39 | 27 |
| 1315 | YGTHLDR | 8.51 | 431.21 | 641.34 | 24 |
| 1316 | YGTHLDR | 8.52 | 431.21 | 687.31 | 24 |
| 1317 | YGTHLDR | 8.51 | 431.21 | 698.36 | 24 |
| 1318 | YLDELVK | 15.52 | 440.24 | 488.31 | 24 |
| 1319 | YLDELVK | 15.53 | 440.24 | 603.33 | 24 |
| 1320 | YLDELVK | 15.52 | 440.24 | 716.42 | 24 |
| 1321 | YLMITEAGR | 15.86 | 527.27 | 533.27 | 28 |
| 1322 | YLMITEAGR | 15.86 | 527.27 | 646.35 | 28 |
| 1323 | YLMITEAGR | 15.86 | 527.27 | 777.39 | 28 |
| 1324 | YLNLFSYGNANIGGGIDK | 22.16 | 639.32 | 773.42 | 36 |
| 1325 | YLNLFSYGNANIGGGIDK | 22.16 | 958.48 | 1015.52 | 47 |
| 1326 | YLNLFSYGNANIGGGIDK | 22.16 | 958.48 | 1178.58 | 47 |
| 1327 | YPVVWYSQQVAHHLGAQR | 18.11 | 535.53 | 544.32 | 30 |
| 1328 | YPVVWYSQQVAHHLGAQR | 18.11 | 535.53 | 681.38 | 30 |
| 1329 | YPVVWYSQQVAHHLGAQR | 18.11 | 535.53 | 889.48 | 30 |
| 1330 | YSNVLAFK | 16.44 | 471.26 | 478.3 | 26 |

TABLE 30-continued

| Transition number | Peptide | Retention time (minutes) | (m/z) filtered in Q1 | (m/z) filtered in Q3 | Collision energy (eV) |
|---|---|---|---|---|---|
| 1331 | YSNVLAFK | 16.44 | 471.26 | 691.41 | 26 |
| 1332 | YSNVLAFK | 16.44 | 471.26 | 778.45 | 26 |
| 1333 | YSPASTFK | 12.22 | 450.73 | 553.3 | 25 |
| 1334 | YSPASTFK | 12.22 | 450.73 | 650.35 | 25 |
| 1335 | YSPASTFK | 12.22 | 450.73 | 737.38 | 25 |
| 1336 | YSVVPVYQQLAR | 18.42 | 711.89 | 778.42 | 36 |
| 1337 | YSVVPVYQQLAR | 18.42 | 711.89 | 974.54 | 36 |
| 1338 | YSVVPVYQQLAR | 18.43 | 711.89 | 1073.61 | 36 |
| 1339 | YSVVWYSQLTAK | 19.75 | 722.88 | 810.44 | 37 |
| 1340 | YSVVWYSQLTAK | 19.76 | 722.88 | 996.51 | 37 |
| 1341 | YSVVWYSQLTAK | 19.76 | 722.88 | 1095.58 | 37 |
| 1342 | YSVVWYSQQVAHHLGAQR | 18.61 | 533.02 | 544.32 | 30 |
| 1343 | YSVVWYSQQVAHHLGAQR | 18.61 | 533.02 | 681.38 | 30 |
| 1344 | YSVVWYSQQVAHHLGAQR | 18.61 | 533.02 | 889.48 | 30 |
| 1345 | YTPASTFK | 11.95 | 305.49 | 553.3 | 19 |
| 1346 | YTPASTFK | 11.98 | 457.73 | 553.3 | 25 |
| 1347 | YTPASTFK | 11.98 | 457.73 | 650.35 | 25 |
| 1348 | YTSAFGYGNADVSGEPGK | 15.03 | 607.28 | 673.35 | 34 |
| 1349 | YTSAFGYGNADVSGEPGK | 15.02 | 607.28 | 788.38 | 34 |
| 1350 | YTSAFGYGNADVSGEPGK | 15.02 | 910.41 | 1030.48 | 45 |
| 1351 | YVFVSALTGNLGSNLTSSIK | 23.66 | 691.04 | 906.49 | 39 |
| 1352 | YVFVSALTGNLGSNLTSSIK | 23.66 | 1036.06 | 1165.63 | 51 |
| 1353 | YVFVSALTGNLGSNLTSSIK | 23.67 | 1036.06 | 1190.64 | 51 |
| 1354 | YVFVSALTGSLGSNLTSSIK | 24.04 | 682.04 | 906.49 | 38 |
| 1355 | YVFVSALTGSLGSNLTSSIK | 24.04 | 1022.55 | 1106.61 | 50 |
| 1356 | YVFVSALTGSLGSNLTSSIK | 24.04 | 1022.55 | 1163.63 | 50 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 25

Identification of a Resistance to ACC Beta-Lactams

Samples Sam96 to Sam101 are identified according to one of the methods described in examples 1, 3 or 4. The identification of the species is set out in TABLE 31.

TABLE 31

| Names | Species |
|---|---|
| Sam96 | K. oxytoca |
| Sam97 | S. livingstone |
| Sam98 | Salmonella spp |
| Sam99 | S. enterica ssp enterica |
| Sam100 | K. pneumoniae |
| Sam101 | H. alvei |

Samples Sam96 to Sam101 correspond to a species able to comprise an ACC resistance mechanism. Each sample is treated according to example 5, then analysed according to example 6 by detecting the peptides from TABLE 32 instead of the peptides from TABLE 3.

TABLE 32

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 1 | ANIDESK | 2 | y4 monocharged | 2.45 | 388.69 | 478.21 | 17.9 | 2500 |
| 2 | ANIDESK | 2 | y5 monocharged | 2.37 | 388.69 | 591.3 | 17.9 | 2500 |
| 3 | ANIDESK | 2 | y6 monocharged | 2.41 | 388.69 | 705.34 | 17.9 | 2500 |
| 4 | AWKPADAAGTHR | 3 | y9 dicharged | 10.61 | 427.56 | 448.22 | 20.3 | 2500 |
| 5 | AWKPADAAGTHR | 3 | y4 monocharged | 10.61 | 427.56 | 470.25 | 20.3 | 2500 |
| 6 | AWKPADAAGTHR | 3 | y10 dicharged | 10.61 | 427.56 | 512.27 | 20.3 | 2500 |
| 7 | DEPVHVNMEILGNEAYGIK | 3 | y9 dicharged | 20.81 | 710.02 | 482.76 | 29.1 | 2500 |
| 8 | DEPVHVNMEILGNEAYGIK | 3 | y8 monocharged | 20.81 | 710.02 | 851.43 | 29.1 | 2500 |
| 9 | DEPVHVNMEILGNEAYGIK | 3 | y9 monocharged | 20.81 | 710.02 | 964.51 | 29.1 | 2500 |
| 10 | DTVDDLIQPLMQK | 3 | y5 monocharged | 22.36 | 505.93 | 616.35 | 22.8 | 2500 |
| 11 | DTVDDLIQPLMQK | 2 | y5 monocharged | 22.36 | 758.39 | 616.35 | 39 | 2500 |
| 12 | DTVDDLIQPLMQK | 2 | y10 monocharged | 22.36 | 758.39 | 1200.63 | 39 | 2500 |
| 13 | ILSSLEGNK | 2 | y6 monocharged | 13.47 | 480.77 | 647.34 | 23.1 | 2500 |
| 14 | ILSSLEGNK | 2 | y7 monocharged | 13.47 | 480.77 | 734.37 | 23.1 | 2500 |
| 15 | ILSSLEGNK | 2 | y8 monocharged | 13.47 | 480.77 | 847.45 | 23.1 | 2500 |
| 16 | LSLDQSVSHYVPELR | 3 | y12 dicharged | 20.27 | 581.64 | 715.36 | 25.1 | 2500 |
| 17 | LSLDQSVSHYVPELR | 3 | y13 dicharged | 20.27 | 581.64 | 771.9 | 25.1 | 2500 |
| 18 | LSLDQSVSHYVPELR | 3 | y14 dicharged | 20.27 | 581.64 | 815.42 | 25.1 | 2500 |
| 19 | MGIVMLANK | 2 | y5 monocharged | 18.15 | 488.77 | 576.32 | 23.6 | 2500 |
| 20 | MGIVMLANK | 2 | y6 monocharged | 18.15 | 488.77 | 675.39 | 23.6 | 2500 |
| 21 | MGIVMLANK | 2 | y8 monocharged | 18.13 | 488.77 | 845.49 | 23.6 | 2500 |
| 22 | MQQALTATHTGYFK | 3 | y9 dicharged | 15.01 | 532.93 | 513.26 | 23.6 | 2500 |
| 23 | MQQALTATHTGYFK | 3 | y11 dicharged | 15.01 | 532.93 | 605.32 | 23.6 | 2500 |
| 24 | MQQALTATHTGYFK | 3 | y12 dicharged | 15.01 | 532.93 | 669.35 | 23.6 | 2500 |
| 25 | NNIPGMSVAVTVNGK | 2 | y5 monocharged | 17.45 | 750.9 | 518.29 | 38.5 | 2500 |
| 26 | NNIPGMSVAVTVNGK | 2 | y12 dicharged | 17.43 | 750.9 | 580.31 | 38.5 | 2500 |
| 27 | NNIPGMSVAVTVNGK | 2 | y12 monocharged | 17.43 | 750.9 | 1159.61 | 38.5 | 2500 |
| 28 | NTTQLMAYLK | 2 | y5 monocharged | 19.34 | 591.81 | 625.34 | 29.5 | 2500 |
| 29 | NTTQLMAYLK | 2 | y6 monocharged | 19.34 | 591.81 | 738.42 | 29.5 | 2500 |
| 30 | NTTQLMAYLK | 2 | y8 monocharged | 19.36 | 591.81 | 967.53 | 29.5 | 2500 |
| 31 | NYIYNYGLAAK | 2 | y7 monocharged | 16.98 | 645.33 | 736.4 | 32.5 | 2500 |
| 32 | NYIYNYGLAAK | 2 | y8 monocharged | 16.98 | 645.33 | 899.46 | 32.5 | 2500 |
| 33 | NYIYNYGLAAK | 2 | y9 monocharged | 16.98 | 645.33 | 1012.55 | 32.5 | 2500 |
| 34 | NYSIDQR | 2 | y3 monocharged | 10.93 | 448.22 | 418.2 | 21.3 | 2500 |
| 35 | NYSIDQR | 2 | y4 monocharged | 10.91 | 448.22 | 531.29 | 21.3 | 2500 |
| 36 | NYSIDQR | 2 | y5 monocharged | 10.91 | 448.22 | 618.32 | 21.3 | 2500 |
| 37 | QPQQPVTENTLFEVGSLSK | 3 | y5 monocharged | 20.77 | 701.36 | 491.28 | 28.8 | 2500 |
| 38 | QPQQPVTENTLFEVGSLSK | 3 | y7 monocharged | 20.77 | 701.36 | 719.39 | 28.8 | 2500 |

TABLE 32-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 39 | QPQQPVTENTLFEVGSLSK | 3 | y8 monocharged | 20.79 | 701.36 | 866.46 | 28.8 | 2500 |
| 40 | SLGVSYEDAIEK | 2 | y6 monocharged | 16.42 | 655.83 | 704.35 | 33.1 | 2500 |
| 41 | SLGVSYEDAIEK | 2 | y8 monocharged | 16.42 | 655.83 | 954.44 | 33.1 | 2500 |
| 42 | SLGVSYEDAIEK | 2 | y10 monocharged | 16.42 | 655.83 | 1110.53 | 33.1 | 2500 |
| 43 | SVATPIVPPLPPQENVWINK | 3 | y10 dicharged | 22.31 | 733.74 | 612.82 | 29.8 | 2500 |
| 44 | SVATPIVPPLPPQENVWINK | 3 | y13 dicharged | 22.29 | 733.74 | 766.42 | 29.8 | 2500 |
| 45 | SVATPIVPPLPPQENVWINK | 3 | y10 monocharged | 22.35 | 733.74 | 1224.64 | 29.8 | 2500 |
| 46 | TFAATLASYAQVSGK | 3 | y6 monocharged | 19.93 | 505.6 | 589.33 | 22.8 | 2500 |
| 47 | TFAATLASYAQVSGK | 2 | y8 monocharged | 19.93 | 757.9 | 839.43 | 38.9 | 2500 |
| 48 | TFAATLASYAQVSGK | 2 | y9 monocharged | 19.93 | 757.9 | 910.46 | 38.9 | 2500 |
| 49 | TGSTNGFGAYIAFVPAK | 3 | y3 monocharged | 21.68 | 567.63 | 315.2 | 24.7 | 2500 |
| 50 | TGSTNGFGAYIAFVPAK | 3 | y6 monocharged | 21.68 | 567.63 | 632.38 | 24.7 | 2500 |
| 51 | TGSTNGFGAYIAFVPAK | 2 | y3 monocharged | 21.68 | 850.94 | 315.2 | 44.2 | 2500 |
| 52 | TLLPQLGMHHSYLK | 3 | y11 dicharged | 17.99 | 546.63 | 655.84 | 24 | 2500 |
| 53 | TLLPQLGMHHSYLK | 3 | y12 dicharged | 17.95 | 546.63 | 712.38 | 24 | 2500 |
| 54 | TLLPQLGMHHSYLK | 2 | y11 dicharged | 17.97 | 819.45 | 655.84 | 42.4 | 2500 |
| 55 | TTSSDLLR | 2 | y4 monocharged | 13 | 446.74 | 516.31 | 21.2 | 2500 |
| 56 | TTSSDLLR | 2 | y5 monocharged | 13 | 446.74 | 603.35 | 21.2 | 2500 |
| 57 | TTSSDLLR | 2 | y6 monocharged | 13 | 446.74 | 690.38 | 21.2 | 2500 |
| 58 | VPADQMENYAWGYNK | 3 | y4 monocharged | 17.53 | 595.94 | 481.24 | 25.6 | 2500 |
| 59 | VPADQMENYAWGYNK | 3 | y5 monocharged | 17.53 | 595.94 | 667.32 | 25.6 | 2500 |
| 60 | VPADQMENYAWGYNK | 3 | y6 monocharged | 17.53 | 595.94 | 738.36 | 25.6 | 2500 |
| 61 | VYSNIGTGLLGMIAAK | 3 | y6 monocharged | 24.59 | 536.63 | 590.33 | 23.7 | 2500 |
| 62 | VYSNIGTGLLGMIAAK | 3 | y7 monocharged | 24.59 | 536.63 | 703.42 | 23.7 | 2500 |
| 63 | VYSNIGTGLLGMIAAK | 2 | y11 monocharged | 24.59 | 804.45 | 1031.59 | 41.6 | 2500 |
| 64 | YVQANMGQLK | 2 | y4 monocharged | 13.88 | 576.3 | 445.28 | 28.6 | 2500 |
| 65 | YVQANMGQLK | 2 | y7 monocharged | 13.88 | 576.3 | 761.4 | 28.6 | 2500 |
| 66 | YVQANMGQLK | 2 | y8 monocharged | 13.88 | 576.3 | 889.46 | 28.6 | 2500 |

The other machine parameters used are as follows:

| | |
|---|---|
| Scan type: | MRM |
| MRM planned: | no |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |

-continued

| | |
|---|---|
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1.32 sec |

The areas obtained for each of the transitions and for each of the microorganisms studied were measured. When the areas of the transitions are greater than or equal to the positivity threshold described in TABLE 32, the detection of the transition is considered to be positive and is labelled "1" in TABLE 33. When a transition has an area less than the positivity threshold described in TABLE 32, the transition is considered non-detected and is labelled "0" in TABLE 33.

For a given peptide, when at least 3 transitions are labelled "1", the peptide is considered as being detected.

TABLE 33

| Transition number | Sam96 | Sam97 | Sam98 | Sam99 | Sam100 | Sam101 |
|---|---|---|---|---|---|---|
| 1 | 0 | 1 | 1 | 1 | 1 | 0 |
| 2 | 0 | 1 | 1 | 1 | 1 | 0 |
| 3 | 0 | 1 | 1 | 1 | 1 | 0 |
| 4 | 1 | 1 | 1 | 1 | 1 | 1 |
| 5 | 1 | 1 | 1 | 1 | 1 | 1 |
| 6 | 1 | 1 | 1 | 1 | 1 | 1 |
| 7 | 1 | 1 | 1 | 1 | 1 | 0 |
| 8 | 1 | 1 | 1 | 1 | 1 | 0 |
| 9 | 1 | 1 | 1 | 1 | 1 | 0 |
| 10 | 1 | 1 | 1 | 1 | 1 | 0 |
| 11 | 1 | 1 | 1 | 1 | 1 | 0 |
| 12 | 1 | 1 | 1 | 1 | 1 | 0 |
| 13 | 1 | 1 | 1 | 1 | 1 | 0 |
| 14 | 1 | 1 | 1 | 1 | 1 | 0 |
| 15 | 1 | 1 | 1 | 1 | 1 | 0 |
| 16 | 1 | 1 | 1 | 1 | 1 | 1 |
| 17 | 1 | 1 | 1 | 1 | 1 | 1 |
| 18 | 1 | 1 | 1 | 1 | 1 | 1 |
| 19 | 1 | 1 | 1 | 1 | 1 | 0 |
| 20 | 1 | 1 | 1 | 1 | 1 | 0 |
| 21 | 1 | 1 | 1 | 1 | 1 | 0 |
| 22 | 1 | 1 | 1 | 1 | 1 | 1 |
| 23 | 1 | 1 | 1 | 1 | 1 | 1 |
| 24 | 1 | 1 | 1 | 1 | 1 | 1 |
| 25 | 1 | 1 | 1 | 1 | 1 | 1 |
| 26 | 1 | 1 | 1 | 1 | 1 | 1 |
| 27 | 1 | 1 | 1 | 1 | 1 | 1 |
| 28 | 1 | 1 | 1 | 1 | 1 | 0 |
| 29 | 1 | 1 | 1 | 1 | 1 | 0 |
| 30 | 1 | 1 | 1 | 1 | 1 | 0 |
| 31 | 1 | 1 | 1 | 1 | 1 | 0 |
| 32 | 1 | 1 | 1 | 1 | 1 | 0 |
| 33 | 1 | 1 | 1 | 1 | 1 | 0 |
| 34 | 1 | 1 | 1 | 1 | 1 | 0 |
| 35 | 1 | 1 | 1 | 1 | 1 | 0 |
| 36 | 1 | 1 | 1 | 1 | 1 | 0 |
| 37 | 1 | 1 | 1 | 1 | 1 | 0 |
| 38 | 1 | 1 | 1 | 1 | 1 | 0 |
| 39 | 1 | 1 | 1 | 1 | 1 | 0 |
| 40 | 1 | 1 | 1 | 1 | 1 | 1 |
| 41 | 1 | 1 | 1 | 1 | 1 | 1 |
| 42 | 1 | 1 | 1 | 1 | 1 | 1 |
| 43 | 1 | 1 | 1 | 1 | 1 | 1 |
| 44 | 1 | 1 | 1 | 1 | 1 | 1 |
| 45 | 1 | 1 | 1 | 1 | 1 | 1 |
| 46 | 1 | 1 | 1 | 1 | 1 | 0 |
| 47 | 1 | 1 | 1 | 1 | 1 | 0 |
| 48 | 1 | 1 | 1 | 1 | 1 | 0 |
| 49 | 1 | 1 | 1 | 1 | 1 | 1 |
| 50 | 1 | 1 | 1 | 1 | 1 | 1 |
| 51 | 1 | 1 | 1 | 1 | 1 | 1 |
| 52 | 1 | 1 | 1 | 1 | 1 | 0 |
| 53 | 1 | 1 | 1 | 1 | 1 | 0 |
| 54 | 1 | 1 | 1 | 1 | 1 | 0 |
| 55 | 1 | 1 | 1 | 1 | 1 | 1 |
| 56 | 1 | 1 | 1 | 1 | 1 | 1 |
| 57 | 1 | 1 | 1 | 1 | 1 | 1 |
| 58 | 1 | 0 | 0 | 0 | 1 | 0 |
| 59 | 1 | 0 | 0 | 0 | 1 | 0 |
| 60 | 1 | 0 | 0 | 0 | 1 | 0 |
| 61 | 1 | 1 | 1 | 1 | 1 | 1 |
| 62 | 1 | 1 | 1 | 1 | 1 | 1 |
| 63 | 1 | 1 | 1 | 1 | 1 | 1 |
| 64 | 1 | 1 | 1 | 1 | 1 | 1 |
| 65 | 1 | 1 | 1 | 1 | 1 | 1 |
| 66 | 1 | 1 | 1 | 1 | 1 | 1 |

Samples Sam96 to Sam101 comprise at least one peptide which is characteristic of the ACC proteins. The bacteria present in samples Sam96 to Sam101 therefore express a beta-lactamase which confers on them a resistance to penicillins and to cephalosporins, with the exception of fourth-generation cephalosporins.

EXAMPLE 26

Identification of a Resistance to CMY Beta-Lactams

Samples Sam102 to Sam108 are identified according to one of the methods described in examples 1, 3 or 4. The identification of the species is set out in TABLE 34.

TABLE 34

| Names | Species |
|---|---|
| Sam102 | P. mirabilis |
| Sam103 | S. senftenberg |
| Sam104 | P. mirabilis |
| Sam105 | K. oxytoca |
| Sam106 | E. coli |
| Sam107 | S. enterica ssp enterica |
| Sam108 | P. mirabilis |

Samples Sam102 to Sam108 correspond to a species able to comprise a CMY resistance mechanism. Each sample is treated according to example 5, then analysed according to example 6 by detecting the peptides from TABLE 35 instead of the peptides from TABLE 3.

TABLE 35

| Transition number | Peptide | Retention time (minutes) | (m/z) filtered in Q1 | (m/z) filtered in Q3 | Collision energy (eV) | Positivity threshold |
|---|---|---|---|---|---|---|
| 1 | AALLHFYQNWQPQWTPGAK | 22.2 | 752.72 | 372.22 | 30.4 | 2500 |
| 2 | AALLHFYQNWQPQWTPGAK | 22.1 | 752.72 | 442.74 | 30.4 | 2500 |
| 3 | AALLHFYQNWQPQWTPGAK | 22.2 | 752.72 | 884.46 | 30.4 | 2500 |
| 4 | ADIANNHPVTQQTLFELGSVSK | 19.9 | 790.41 | 427.27 | 31.6 | 2500 |
| 5 | ADIANNHPVTQQTLFELGSVSK | 19.9 | 790.41 | 719.39 | 31.6 | 2500 |
| 6 | ADIANNHPVTQQTLFELGSVSK | 19.9 | 790.41 | 866.46 | 31.6 | 2500 |

TABLE 35-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 7 | ADSIINGSDSK | 11.3 | 553.77 | 493.23 | 27.3 | 2500 |
| 8 | ADSIINGSDSK | 11.3 | 553.77 | 607.27 | 27.3 | 2500 |
| 9 | ADSIINGSDSK | 11.3 | 553.77 | 720.35 | 27.3 | 2500 |
| 10 | ANIGGVDDK | 10 | 444.73 | 533.26 | 21.1 | 2500 |
| 11 | ANIGGVDDK | 10 | 444.73 | 590.28 | 21.1 | 2500 |
| 12 | ANIGGVDDK | 10.1 | 444.73 | 703.36 | 21.1 | 2500 |
| 13 | ASWVHK | 9.3 | 364.2 | 383.24 | 16.5 | 2500 |
| 14 | ASWVHK | 9.3 | 364.2 | 569.32 | 16.5 | 2500 |
| 15 | ASWVHK | 9.3 | 364.2 | 656.35 | 16.5 | 2500 |
| 16 | DYAWGYR | 15.6 | 465.71 | 395.2 | 22.3 | 2500 |
| 17 | DYAWGYR | 15.6 | 465.71 | 581.28 | 22.3 | 2500 |
| 18 | DYAWGYR | 15.6 | 465.71 | 652.32 | 22.3 | 2500 |
| 19 | ESGSQVLFNK | 14.5 | 554.79 | 408.22 | 27.4 | 2500 |
| 20 | ESGSQVLFNK | 14.5 | 554.79 | 521.31 | 27.4 | 2500 |
| 21 | ESGSQVLFNK | 14.5 | 554.79 | 620.38 | 27.4 | 2500 |
| 22 | GAMQLDDK | 11.4 | 439.21 | 490.25 | 20.8 | 2500 |
| 23 | GAMQLDDK | 11.4 | 439.21 | 618.31 | 20.8 | 2500 |
| 24 | GAMQLDDK | 11.4 | 439.21 | 749.35 | 20.8 | 2500 |
| 25 | GIGIVMLANR | 19.9 | 522.31 | 604.32 | 25.5 | 2500 |
| 26 | GIGIVMLANR | 19.9 | 522.31 | 703.39 | 25.5 | 2500 |
| 27 | GIGIVMLANR | 19.9 | 522.31 | 873.5 | 25.5 | 2500 |
| 28 | IGDMYQGLGWEMLNWPLK | 27.9 | 717.69 | 357.25 | 29.3 | 2500 |
| 29 | IGDMYQGLGWEMLNWPLK | 27.9 | 717.69 | 657.37 | 29.3 | 2500 |
| 30 | IGDMYQGLGWEMLNWPLK | 27.9 | 717.69 | 901.5 | 29.3 | 2500 |
| 31 | IPGMAVAVLK | 19.3 | 499.81 | 600.41 | 24.2 | 2500 |
| 32 | IPGMAVAVLK | 19.3 | 499.81 | 788.47 | 24.2 | 2500 |
| 33 | IPGMAVAVLK | 19.3 | 499.81 | 885.52 | 24.2 | 2500 |
| 34 | LAHTWITVPQNEQK | 16.5 | 832.94 | 743.37 | 43.2 | 2500 |
| 35 | LAHTWITVPQNEQK | 16.5 | 832.94 | 943.48 | 43.2 | 2500 |
| 36 | LAHTWITVPQNEQK | 16.5 | 832.94 | 1242.65 | 43.2 | 2500 |
| 37 | LLHLATYTAGGLPLQIPDDVR | 22.8 | 755.09 | 526.79 | 30.5 | 2500 |
| 38 | LLHLATYTAGGLPLQIPDDVR | 23 | 755.09 | 601.29 | 30.5 | 2500 |
| 39 | LLHLATYTAGGLPLQIPDDVR | 23 | 755.09 | 1052.57 | 30.5 | 2500 |
| 40 | LSDPVTK | 11.1 | 380.22 | 444.28 | 17.4 | 2500 |
| 41 | LSDPVTK | 11.1 | 380.22 | 559.31 | 17.4 | 2500 |
| 42 | LSDPVTK | 11.1 | 380.22 | 646.34 | 17.4 | 2500 |
| 43 | NLGIVMLANK | 19.6 | 536.81 | 576.32 | 26.3 | 2500 |
| 44 | NLGIVMLANK | 19.6 | 536.81 | 675.39 | 26.3 | 2500 |

TABLE 35-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 45 | NLGIVMLANK | 19.6 | 536.81 | 845.49 | 26.3 | 2500 |
| 46 | QAMASYAYGYSK | 14.1 | 670.3 | 454.23 | 33.9 | 2500 |
| 47 | QAMASYAYGYSK | 14.2 | 670.3 | 617.29 | 33.9 | 2500 |
| 48 | QAMASYAYGYSK | 14.1 | 670.3 | 688.33 | 33.9 | 2500 |
| 49 | QWAPVYSPGSHR | 14.7 | 692.84 | 553.28 | 35.2 | 2500 |
| 50 | QWAPVYSPGSHR | 14.8 | 692.84 | 640.32 | 35.2 | 2500 |
| 51 | QWAPVYSPGSHR | 14.8 | 692.84 | 999.5 | 35.2 | 2500 |
| 52 | QWQGIR | 13.1 | 394.21 | 345.22 | 18.2 | 2500 |
| 53 | QWQGIR | 13.1 | 394.21 | 473.28 | 18.2 | 2500 |
| 54 | QWQGIR | 13.1 | 394.21 | 659.36 | 18.2 | 2500 |
| 55 | SSVIDMAR | 14.3 | 439.72 | 492.22 | 20.8 | 2500 |
| 56 | SSVIDMAR | 14.3 | 439.72 | 605.31 | 20.8 | 2500 |
| 57 | SSVIDMAR | 14.3 | 439.72 | 704.38 | 20.8 | 2500 |
| 58 | SYPNPVR | 11.6 | 416.72 | 371.24 | 19.5 | 2500 |
| 59 | SYPNPVR | 11.6 | 416.72 | 485.28 | 19.5 | 2500 |
| 60 | SYPNPVR | 11.6 | 416.72 | 582.34 | 19.5 | 2500 |
| 61 | TEQQIADIVNR | 15.8 | 643.84 | 616.34 | 32.4 | 2500 |
| 62 | TEQQIADIVNR | 15.8 | 643.84 | 687.38 | 32.4 | 2500 |
| 63 | TEQQIADIVNR | 15.8 | 643.84 | 800.46 | 32.4 | 2500 |
| 64 | TFNGVLGGDAIAR | 17.9 | 645.84 | 602.33 | 32.5 | 2500 |
| 65 | TFNGVLGGDAIAR | 17.9 | 645.84 | 659.35 | 32.5 | 2500 |
| 66 | TFNGVLGGDAIAR | 17.9 | 645.84 | 772.43 | 32.5 | 2500 |
| 67 | TITPLMQEQAIPGMAVAVIYQGK | 24.9 | 820.44 | 617.34 | 32.5 | 2500 |
| 68 | TITPLMQEQAIPGMAVAVIYQGK | 25 | 820.44 | 778.45 | 32.5 | 2500 |
| 69 | TITPLMQEQAIPGMAVAVIYQGK | 24.9 | 820.44 | 1233.67 | 32.5 | 2500 |
| 70 | TLQQGIALAQSR | 15.5 | 643.37 | 574.33 | 32.4 | 2500 |
| 71 | TLQQGIALAQSR | 15.5 | 643.37 | 645.37 | 32.4 | 2500 |
| 72 | TLQQGIALAQSR | 15.5 | 643.37 | 815.47 | 32.4 | 2500 |
| 73 | TLTATLGAYAVVK | 19.7 | 654.38 | 707.41 | 33 | 2500 |
| 74 | TLTATLGAYAVVK | 19.7 | 654.38 | 820.49 | 33 | 2500 |
| 75 | TLTATLGAYAVVK | 19.7 | 654.38 | 921.54 | 33 | 2500 |
| 76 | VALAALPAVEVNPPAPAVK | 21.1 | 609.7 | 644.87 | 26 | 2500 |
| 77 | VALAALPAVEVNPPAPAVK | 21 | 609.7 | 679.41 | 26 | 2500 |
| 78 | VALAALPAVEVNPPAPAVK | 21 | 609.7 | 793.46 | 26 | 2500 |
| 79 | VEAAWR | 12 | 366.2 | 432.24 | 16.6 | 2500 |
| 80 | VEAAWR | 12 | 366.2 | 503.27 | 16.6 | 2500 |
| 81 | VEAAWR | 12 | 366.2 | 632.32 | 16.6 | 2500 |
| 82 | VLQPLK | 13.1 | 349.23 | 357.25 | 15.6 | 2500 |

TABLE 35-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 83 | VLQPLK | 13.1 | 349.23 | 485.31 | 15.6 | 2500 |
| 84 | VLQPLK | 13 | 349.23 | 598.39 | 15.6 | 2500 |
| 85 | VNPGMLADEAYGIK | 18.8 | 739.37 | 632.82 | 37.9 | 2500 |
| 86 | VNPGMLADEAYGIK | 18.9 | 739.37 | 795.39 | 37.9 | 2500 |
| 87 | VNPGMLADEAYGIK | 18.9 | 739.37 | 866.43 | 37.9 | 2500 |
| 88 | WVQANMDASHVQEK | 13.4 | 548.26 | 615.28 | 24.1 | 2500 |
| 89 | WVQANMDASHVQEK | 13.4 | 548.26 | 679.31 | 24.1 | 2500 |
| 90 | WVQANMDASHVQEK | 13.4 | 548.26 | 728.85 | 24.1 | 2500 |
| 91 | YWPELTGK | 17.8 | 497.26 | 305.18 | 24.1 | 2500 |
| 92 | YWPELTGK | 17.8 | 497.26 | 418.27 | 24.1 | 2500 |
| 93 | YWPELTGK | 17.8 | 497.26 | 644.36 | 24.1 | 2500 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 0.04 sec |
| Detection window: | 120 sec |

The areas obtained for each of the transitions and for each of the microorganisms studied were measured. When the areas of the transitions are greater than or equal to the positivity threshold described in TABLE 35, the detection of the transition is considered to be positive and is labelled "1" in TABLE 36. When a transition has an area less than the positivity threshold described in TABLE 35, the transition is considered non-detected and is labelled "0" in TABLE 36.

For a given peptide, when at least 3 transitions are labelled "1", the peptide is considered as being detected.

TABLE 36

| Transition number | Sam102 | Sam103 | Sam104 | Sam105 | Sam106 | Sam107 | Sam108 |
|---|---|---|---|---|---|---|---|
| 1 | 0 | 0 | 0 | 1 | 0 | 0 | 1 |
| 2 | 0 | 0 | 0 | 1 | 0 | 0 | 1 |
| 3 | 0 | 0 | 0 | 1 | 0 | 0 | 1 |
| 4 | 0 | 0 | 0 | 0 | 1 | 0 | 0 |
| 5 | 0 | 0 | 0 | 0 | 1 | 0 | 0 |
| 6 | 0 | 0 | 0 | 0 | 1 | 0 | 0 |
| 7 | 1 | 1 | 1 | 1 | 1 | 1 | 1 |
| 8 | 1 | 1 | 1 | 1 | 1 | 1 | 1 |
| 9 | 1 | 1 | 1 | 1 | 1 | 1 | 1 |
| 10 | 0 | 0 | 0 | 0 | 0 | 0 | 0 |
| 11 | 0 | 0 | 0 | 0 | 0 | 0 | 0 |
| 12 | 0 | 0 | 0 | 0 | 0 | 0 | 0 |
| 13 | 1 | 1 | 1 | 1 | 1 | 1 | 1 |
| 14 | 1 | 1 | 1 | 1 | 1 | 1 | 1 |
| 15 | 1 | 1 | 1 | 1 | 1 | 1 | 1 |
| 16 | 0 | 1 | 0 | 1 | 1 | 1 | 0 |
| 17 | 0 | 1 | 0 | 1 | 1 | 1 | 0 |
| 18 | 0 | 1 | 0 | 1 | 1 | 1 | 0 |
| 19 | 0 | 0 | 0 | 1 | 0 | 0 | 0 |
| 20 | 0 | 0 | 0 | 1 | 0 | 0 | 0 |
| 21 | 0 | 0 | 0 | 1 | 0 | 0 | 0 |
| 22 | 0 | 0 | 0 | 0 | 0 | 0 | 1 |
| 23 | 0 | 0 | 0 | 0 | 0 | 0 | 1 |
| 24 | 0 | 0 | 0 | 0 | 0 | 0 | 1 |
| 25 | 0 | 0 | 0 | 0 | 0 | 0 | 0 |
| 26 | 0 | 0 | 0 | 0 | 0 | 0 | 0 |
| 27 | 0 | 0 | 0 | 0 | 0 | 0 | 0 |
| 28 | 0 | 0 | 0 | 1 | 0 | 0 | 0 |
| 29 | 0 | 0 | 0 | 1 | 0 | 0 | 0 |
| 30 | 0 | 0 | 0 | 1 | 0 | 0 | 0 |
| 31 | 0 | 0 | 0 | 0 | 0 | 0 | 0 |
| 32 | 0 | 0 | 0 | 0 | 0 | 0 | 0 |
| 33 | 0 | 0 | 0 | 0 | 0 | 0 | 0 |
| 34 | 1 | 1 | 1 | 1 | 1 | 1 | 1 |
| 35 | 1 | 1 | 1 | 1 | 1 | 1 | 1 |
| 36 | 1 | 1 | 1 | 1 | 1 | 1 | 1 |
| 37 | 0 | 0 | 0 | 0 | 0 | 0 | 0 |
| 38 | 0 | 0 | 0 | 0 | 0 | 0 | 0 |
| 39 | 0 | 0 | 0 | 0 | 0 | 0 | 0 |
| 40 | 1 | 1 | 1 | 1 | 0 | 1 | 1 |
| 41 | 1 | 1 | 1 | 1 | 0 | 1 | 1 |
| 42 | 1 | 1 | 1 | 1 | 0 | 1 | 1 |
| 43 | 1 | 1 | 1 | 1 | 1 | 1 | 1 |
| 44 | 1 | 1 | 1 | 1 | 1 | 1 | 1 |
| 45 | 1 | 1 | 1 | 1 | 1 | 1 | 1 |
| 46 | 0 | 0 | 0 | 0 | 0 | 0 | 0 |

TABLE 36-continued

| Transition number | Sam102 | Sam103 | Sam104 | Sam105 | Sam106 | Sam107 | Sam108 |
|---|---|---|---|---|---|---|---|
| 47 | 0 | 0 | 0 | 0 | 0 | 0 | 0 |
| 48 | 0 | 0 | 0 | 0 | 0 | 0 | 0 |
| 49 | 0 | 0 | 0 | 0 | 0 | 0 | 0 |
| 50 | 0 | 0 | 0 | 0 | 0 | 0 | 0 |
| 51 | 0 | 0 | 0 | 0 | 0 | 0 | 0 |
| 52 | 1 | 1 | 1 | 1 | 1 | 1 | 1 |
| 53 | 1 | 1 | 1 | 1 | 1 | 1 | 1 |
| 54 | 1 | 1 | 1 | 1 | 1 | 1 | 1 |
| 55 | 1 | 1 | 1 | 1 | 1 | 1 | 1 |
| 56 | 1 | 1 | 1 | 1 | 1 | 1 | 1 |
| 57 | 1 | 1 | 1 | 1 | 1 | 1 | 1 |
| 58 | 0 | 1 | 1 | 1 | 1 | 0 | 1 |
| 59 | 0 | 1 | 1 | 1 | 1 | 0 | 1 |
| 60 | 0 | 1 | 1 | 1 | 1 | 0 | 1 |
| 61 | 1 | 1 | 1 | 1 | 1 | 1 | 1 |
| 62 | 1 | 1 | 1 | 1 | 1 | 1 | 1 |
| 63 | 1 | 1 | 1 | 1 | 1 | 1 | 1 |
| 64 | 1 | 1 | 1 | 1 | 1 | 1 | 1 |
| 65 | 1 | 1 | 1 | 1 | 1 | 1 | 1 |
| 66 | 1 | 1 | 1 | 1 | 1 | 1 | 1 |
| 67 | 1 | 0 | 0 | 0 | 0 | 1 | 0 |
| 68 | 1 | 0 | 0 | 0 | 0 | 1 | 0 |
| 69 | 1 | 0 | 0 | 0 | 0 | 1 | 0 |
| 70 | 1 | 1 | 1 | 1 | 1 | 1 | 1 |
| 71 | 1 | 1 | 1 | 1 | 1 | 1 | 1 |
| 72 | 1 | 1 | 1 | 1 | 1 | 1 | 1 |
| 73 | 0 | 0 | 0 | 0 | 0 | 0 | 0 |
| 74 | 0 | 0 | 0 | 0 | 0 | 0 | 0 |
| 75 | 0 | 0 | 0 | 0 | 0 | 0 | 0 |
| 76 | 1 | 1 | 1 | 1 | 1 | 1 | 1 |
| 77 | 1 | 1 | 1 | 1 | 1 | 1 | 1 |
| 78 | 1 | 1 | 1 | 1 | 1 | 1 | 1 |
| 79 | 1 | 1 | 1 | 1 | 1 | 1 | 1 |
| 80 | 1 | 1 | 1 | 1 | 1 | 1 | 1 |
| 81 | 1 | 1 | 1 | 1 | 1 | 1 | 1 |
| 82 | 1 | 1 | 1 | 1 | 1 | 1 | 1 |
| 83 | 1 | 1 | 1 | 1 | 1 | 1 | 1 |
| 84 | 1 | 1 | 1 | 1 | 1 | 1 | 1 |
| 85 | 0 | 0 | 1 | 0 | 1 | 1 | 1 |
| 86 | 0 | 0 | 1 | 0 | 1 | 1 | 1 |
| 87 | 0 | 0 | 1 | 0 | 1 | 1 | 1 |
| 88 | 1 | 1 | 1 | 1 | 1 | 1 | 1 |
| 89 | 1 | 1 | 1 | 1 | 1 | 1 | 1 |
| 90 | 1 | 1 | 1 | 1 | 1 | 1 | 1 |
| 91 | 1 | 1 | 1 | 1 | 0 | 1 | 1 |
| 92 | 1 | 1 | 1 | 1 | 0 | 1 | 1 |
| 93 | 1 | 1 | 1 | 1 | 0 | 1 | 1 |

Samples Sam102 to Sam108 comprise at least one peptide which is characteristic of the CMY proteins. The bacteria present in samples Sam102 to Sam108 therefore express a beta-lactamase which confers on them a resistance to penicillins and to cephalosporins, with the exception of fourth-generation cephalosporins.

EXAMPLE 27

Identification of a Resistance to CTX-M Beta-Lactams

Samples Sam109 to Sam118 are identified according to one of the methods described in examples 1, 3 or 4. The identification of the species is set out in TABLE 37.

TABLE 37

| Names | Species |
|---|---|
| Sam109 | *E. aerogenes* |
| Sam110 | *E. coli* |
| Sam111 | *E. coli* |
| Sam112 | *E. coli* |
| Sam113 | *E. coli* |
| Sam114 | *K. pneumoniae* |
| Sam115 | *K. pneumoniae* |
| Sam116 | *P. mirabilis* |
| Sam117 | *Salmonella* spp |
| Sam118 | *Salmonella* spp |

Samples Sam109 to Sam118 correspond to a species able to comprise a CTX-M resistance mechanism. Each sample is treated according to example 5, then analysed according to example 6 by detecting the peptides from TABLE 38 instead of the peptides from TABLE 3.

TABLE 38

| Transition number | Peptide | Charge state of the precursor | Charge state of the fragment | Fragment ion | Retention time (minutes) | (m/z) filtered in Q1 | (m/z) filtered in Q3 | Collision energy (eV) | Positivity threshold |
|---|---|---|---|---|---|---|---|---|---|
| 1 | AGLPK | 2 | 1 | y4 | 8.4 | 243.16 | 414.27 | 9.6 | 3000 |
| 2 | AGLPK | 2 | 1 | y3 | 8.4 | 243.16 | 357.25 | 9.6 | 3000 |
| 3 | AGLPK | 2 | 2 | y3 | 8.4 | 243.16 | 179.13 | 9.6 | 3000 |
| 4 | AGLPTSWTVGDK | 2 | 1 | y9 | 18 | 616.32 | 990.49 | 30.9 | 2000 |
| 5 | AGLPTSWTVGDK | 2 | 1 | y7 | 18 | 616.32 | 792.39 | 30.9 | 2000 |
| 6 | AGLPTSWTVGDK | 2 | 2 | y9 | 17.9 | 616.32 | 495.75 | 30.9 | 2000 |
| 7 | AIGDETFR | 2 | 1 | y6 | 13.5 | 454.73 | 724.33 | 21.7 | 2000 |
| 8 | AIGDETFR | 2 | 1 | y5 | 13.5 | 454.73 | 667.31 | 21.7 | 2000 |
| 9 | AIGDETFR | 2 | 1 | y4 | 13.5 | 454.73 | 552.28 | 21.7 | 2000 |
| 10 | ALAETQR | 2 | 1 | y5 | 7.5 | 394.72 | 604.31 | 18.2 | 2000 |
| 11 | ALAETQR | 2 | 1 | y4 | 7.5 | 394.72 | 533.27 | 18.2 | 2000 |

TABLE 38-continued

| Transition number | Peptide | Charge state of the precursor | Charge state of the fragment | Fragment ion | Retention time (minutes) | (m/z) filtered in Q1 | (m/z) filtered in Q3 | Collision energy (eV) | Positivity threshold |
|---|---|---|---|---|---|---|---|---|---|
| 12 | ALAETQR | 2 | 2 | y6 | 7.5 | 394.72 | 359.2 | 18.2 | 2000 |
| 13 | ALGDSQR | 2 | 1 | y5 | 3.5 | 373.69 | 562.26 | 17 | 2000 |
| 14 | ALGDSQR | 2 | 1 | y3 | 3.6 | 373.69 | 390.21 | 17 | 2000 |
| 15 | ALGDSQR | 2 | 2 | y6 | 3.5 | 373.69 | 338.18 | 17 | 2000 |
| 16 | AMAQTLR | 2 | 1 | y5 | 10.7 | 395.72 | 588.35 | 18.3 | 2000 |
| 17 | AMAQTLR | 2 | 1 | y4 | 10.7 | 395.72 | 517.31 | 18.3 | 2000 |
| 18 | AMAQTLR | 2 | 1 | y3 | 10.7 | 395.72 | 389.25 | 18.3 | 2000 |
| 19 | APLILVTYFTQPQPK | 2 | 1 | y10 | 24.6 | 858.49 | 1208.63 | 44.7 | 2000 |
| 20 | APLILVTYFTQPQPK | 3 | 1 | y6 | 24.6 | 572.66 | 698.38 | 24.8 | 2000 |
| 21 | APLILVTYFTQPQPK | 3 | 1 | y4 | 24.6 | 572.66 | 469.28 | 24.8 | 2000 |
| 22 | APLVLVTYFTQPQQNAESR | 3 | 1 | y8 | 23.6 | 721.38 | 929.44 | 29.4 | 2000 |
| 23 | APLVLVTYFTQPQQNAESR | 3 | 1 | y6 | 23.6 | 721.38 | 704.33 | 29.4 | 2000 |
| 24 | APLVLVTYFTQPQQNAESR | 3 | 2 | y8 | 23.6 | 721.38 | 465.23 | 29.4 | 2000 |
| 25 | AQLVTWLK | 2 | 1 | y6 | 20 | 479.79 | 759.48 | 23.1 | 2000 |
| 26 | AQLVTWLK | 2 | 1 | y5 | 20 | 479.79 | 646.39 | 23.1 | 2000 |
| 27 | AQLVTWLK | 2 | 1 | y4 | 20 | 479.79 | 547.32 | 23.1 | 2000 |
| 28 | AQLVTWMK | 2 | 1 | y6 | 18.5 | 488.77 | 777.43 | 23.6 | 2000 |
| 29 | AQLVTWMK | 2 | 1 | y5 | 18.6 | 488.77 | 664.35 | 23.6 | 2000 |
| 30 | AQLVTWMK | 2 | 1 | y4 | 18.5 | 488.77 | 565.28 | 23.6 | 2000 |
| 31 | DILAAAAK | 2 | 1 | y6 | 14.1 | 386.73 | 544.35 | 17.8 | 2000 |
| 32 | DILAAAAK | 2 | 1 | y5 | 14.1 | 386.73 | 431.26 | 17.8 | 2000 |
| 33 | DILAAAAK | 2 | 1 | y4 | 14.1 | 386.73 | 360.22 | 17.8 | 2000 |
| 34 | DTTSPR | 2 | 1 | y5 | 1 | 338.67 | 561.3 | 15 | 2000 |
| 35 | DTTSPR | 2 | 1 | y4 | 1 | 338.67 | 460.25 | 15 | 2000 |
| 36 | DTTSPR | 2 | 1 | y3 | 1 | 338.67 | 359.2 | 15 | 2000 |
| 37 | DTTTPLAMAQTLK | 2 | 1 | y9 | 19.4 | 695.87 | 972.56 | 35.4 | 2000 |
| 38 | DTTTPLAMAQTLK | 2 | 1 | y7 | 19.4 | 695.87 | 762.42 | 35.4 | 2000 |
| 39 | DTTTPLAMAQTLK | 2 | 2 | y9 | 19.4 | 695.87 | 486.78 | 35.4 | 2000 |
| 40 | DTTTPR | 2 | 1 | y5 | 1 | 345.67 | 575.32 | 15.4 | 2000 |
| 41 | DTTTPR | 2 | 1 | y4 | 1 | 345.67 | 474.27 | 15.4 | 2000 |
| 42 | DTTTPR | 2 | 1 | y3 | 1 | 345.67 | 373.22 | 15.4 | 2000 |
| 43 | DVLAAAAK | 2 | 1 | y6 | 12.2 | 379.72 | 544.35 | 17.4 | 2000 |
| 44 | DVLAAAAK | 2 | 1 | y5 | 12.2 | 379.72 | 431.26 | 17.4 | 2000 |
| 45 | DVLAAAAK | 2 | 1 | y4 | 12.2 | 379.72 | 360.22 | 17.4 | 2000 |
| 46 | DVLASAAK | 2 | 1 | y6 | 11.4 | 387.72 | 560.34 | 17.8 | 2000 |
| 47 | DVLASAAK | 2 | 1 | y5 | 11.4 | 387.72 | 447.26 | 17.8 | 2000 |
| 48 | DVLASAAK | 2 | 1 | y4 | 11.4 | 387.72 | 376.22 | 17.8 | 2000 |
| 49 | DVLASAAR | 2 | 1 | y6 | 11.9 | 401.73 | 588.35 | 18.6 | 2000 |

TABLE 38-continued

| Transition number | Peptide | Charge state of the precursor | Charge state of the fragment | Fragment ion | Retention time (minutes) | (m/z) filtered in Q1 | (m/z) filtered in Q3 | Collision energy (eV) | Positivity threshold |
|---|---|---|---|---|---|---|---|---|---|
| 50 | DVLASAAR | 2 | 1 | y5 | 11.9 | 401.73 | 475.26 | 18.6 | 2000 |
| 51 | DVLASAAR | 2 | 1 | y4 | 11.9 | 401.73 | 404.23 | 18.6 | 2000 |
| 52 | FAMCSTSK | 2 | 1 | y7 | 11.6 | 466.2 | 784.33 | 22.3 | 2000 |
| 53 | FAMCSTSK | 2 | 1 | y6 | 11.6 | 466.2 | 713.3 | 22.3 | 2000 |
| 54 | FAMCSTSK | 2 | 1 | y5 | 11.6 | 466.2 | 582.26 | 22.3 | 2000 |
| 55 | FPMCSTSK | 2 | 1 | y7 | 12.3 | 479.21 | 810.35 | 23.1 | 2000 |
| 56 | FPMCSTSK | 2 | 1 | y6 | 12.3 | 479.21 | 713.3 | 23.1 | 2000 |
| 57 | FPMCSTSK | 2 | 2 | y7 | 12.3 | 479.21 | 405.68 | 23.1 | 2000 |
| 58 | GNTTGAASIQAGLPASWVVGDK | 3 | 1 | y9 | 21.1 | 700.7 | 958.5 | 29.1 | 2000 |
| 59 | GNTTGAASIQAGLPASWVVGDK | 3 | 1 | y7 | 21.1 | 700.7 | 790.41 | 29.1 | 2000 |
| 60 | GNTTGAASIQAGLPASWVVGDK | 3 | 2 | y9 | 21.2 | 700.7 | 479.75 | 29.1 | 2000 |
| 61 | GNTTGAASIQAGLPTSWVVGDK | 3 | 1 | y9 | 21.3 | 710.7 | 988.51 | 29.1 | 8500 |
| 62 | GNTTGAASIQAGLPTSWVVGDK | 3 | 2 | y9 | 21.3 | 710.7 | 494.76 | 29.1 | 8500 |
| 63 | GNTTGAASIQAGLPTSWVVGDK | 3 | 1 | y3 | 21.3 | 710.7 | 319.16 | 29.1 | 8500 |
| 64 | GNTTGAASIR | 2 | 1 | y7 | 9.3 | 474.25 | 675.38 | 22.8 | 2000 |
| 65 | GNTTGAASIR | 2 | 1 | y6 | 9.3 | 474.25 | 574.33 | 22.8 | 2000 |
| 66 | GNTTGAASIR | 2 | 1 | y4 | 9.3 | 474.25 | 446.27 | 22.8 | 2000 |
| 67 | GNTTGSASIR | 2 | 1 | y8 | 8 | 482.25 | 792.42 | 23.2 | 2000 |
| 68 | GNTTGSASIR | 2 | 1 | y7 | 8 | 482.25 | 691.37 | 23.2 | 2000 |
| 69 | GNTTGSASIR | 2 | 1 | y6 | 8 | 482.25 | 590.33 | 23.2 | 2000 |
| 70 | HLLNQR | 2 | 1 | y5 | 8.1 | 390.73 | 643.39 | 18 | 2000 |
| 71 | HLLNQR | 2 | 1 | y4 | 8.1 | 390.73 | 530.31 | 18 | 2000 |
| 72 | HLLNQR | 2 | 1 | y3 | 8.1 | 390.73 | 417.22 | 18 | 2000 |
| 73 | LAALEK | 2 | 1 | y5 | 11.3 | 322.7 | 531.31 | 14.1 | 2000 |
| 74 | LAALEK | 2 | 1 | y4 | 11.3 | 322.7 | 460.28 | 14.1 | 2000 |
| 75 | LAALEK | 2 | 1 | y3 | 11.3 | 322.7 | 389.24 | 14.1 | 2000 |
| 76 | LAELER | 2 | 1 | y5 | 11.7 | 365.71 | 617.33 | 16.6 | 2000 |
| 77 | LAELER | 2 | 1 | y4 | 11.7 | 365.71 | 546.29 | 16.6 | 2000 |
| 78 | LAELER | 2 | 1 | y3 | 11.7 | 365.71 | 417.25 | 16.6 | 2000 |
| 79 | LGVALIDTADNTQVLYR | 3 | 1 | y6 | 21.5 | 621.34 | 779.44 | 26.3 | 2000 |
| 80 | LGVALIDTADNTQVLYR | 3 | 1 | y5 | 21.5 | 621.34 | 678.39 | 26.3 | 2000 |
| 81 | LGVALIDTADNTQVLYR | 3 | 1 | y4 | 21.5 | 621.34 | 550.34 | 26.3 | 2000 |
| 82 | LGVALIDTADNTQVLYR | 3 | 1 | y3 | 21.4 | 621.34 | 451.27 | 26.3 | 2000 |
| 83 | LGVALINTADNSQILYR | 3 | 1 | y6 | 21.4 | 621.01 | 779.44 | 26.3 | 2000 |
| 84 | LGVALINTADNSQILYR | 3 | 1 | y5 | 21.4 | 621.01 | 692.41 | 26.3 | 2000 |
| 85 | LGVALINTADNSQILYR | 3 | 1 | y4 | 21.4 | 621.01 | 564.35 | 26.3 | 2000 |
| 86 | LGVALINTADNSQILYR | 3 | 1 | y3 | 21.4 | 621.01 | 451.27 | 26.3 | 2000 |
| 87 | LIAHLGGPDK | 3 | 1 | y6 | 13.2 | 340.87 | 586.32 | 17.6 | 2000 |

TABLE 38-continued

| Transition number | Peptide | Charge state of the precursor | Charge state of the fragment | Fragment ion | Retention time (minutes) | (m/z) filtered in Q1 | (m/z) filtered in Q3 | Collision energy (eV) | Positivity threshold |
|---|---|---|---|---|---|---|---|---|---|
| 88 | LIAHLGGPDK | 3 | 2 | y9 | 13.2 | 340.87 | 454.25 | 17.6 | 2000 |
| 89 | LIAHLGGPDK | 3 | 2 | y8 | 13.2 | 340.87 | 397.71 | 17.6 | 2000 |
| 90 | LIAHVGGPASVTAFAR | 3 | 1 | y5 | 17.7 | 522.96 | 565.31 | 23.3 | 2000 |
| 91 | LIAHVGGPASVTAFAR | 3 | 1 | y4 | 17.7 | 522.96 | 464.26 | 23.3 | 2000 |
| 92 | LIAHVGGPASVTAFAR | 3 | 1 | y3 | 17.7 | 522.96 | 393.22 | 23.3 | 2000 |
| 93 | LIAQLGGPGGVTAFAR | 2 | 1 | y11 | 20.3 | 764.44 | 989.52 | 39.3 | 2000 |
| 94 | LIAQLGGPGGVTAFAR | 2 | 1 | y9 | 20.3 | 764.44 | 875.47 | 39.3 | 2000 |
| 95 | LIAQLGGPGGVTAFAR | 3 | 1 | y5 | 20.3 | 509.96 | 565.31 | 22.9 | 2000 |
| 96 | NLTLGK | 2 | 1 | y5 | 12.3 | 323.2 | 531.35 | 14.2 | 2000 |
| 97 | NLTLGK | 2 | 1 | y4 | 12.3 | 323.2 | 418.27 | 14.2 | 2000 |
| 98 | NLTLGK | 2 | 1 | y3 | 12.3 | 323.2 | 317.22 | 14.2 | 2000 |
| 99 | QLGDETFR | 2 | 1 | y6 | 13.6 | 483.24 | 724.33 | 23.3 | 2000 |
| 100 | QLGDETFR | 2 | 1 | y4 | 13.6 | 483.24 | 552.28 | 23.3 | 2000 |
| 101 | QLGDETFR | 2 | 1 | y3 | 13.6 | 483.24 | 423.24 | 23.3 | 2000 |
| 102 | QLTLGHALGETQR | 3 | 2 | y11 | 15.6 | 475.26 | 591.82 | 21.8 | 2000 |
| 103 | QLTLGHALGETQR | 3 | 1 | y5 | 15.6 | 475.26 | 590.29 | 21.8 | 2000 |
| 104 | QLTLGHALGETQR | 3 | 2 | y10 | 15.6 | 475.26 | 541.29 | 21.8 | 2000 |
| 105 | QSESDK | 2 | 1 | y5 | 0.8 | 347.16 | 565.25 | 15.5 | 2000 |
| 106 | QSESDK | 2 | 1 | y4 | 0.8 | 347.16 | 478.21 | 15.5 | 2000 |
| 107 | QSESDK | 2 | 1 | y3 | 0.8 | 347.16 | 349.17 | 15.5 | 2000 |
| 108 | QSETQK | 2 | 1 | y5 | 0.8 | 360.68 | 592.29 | 16.3 | 2000 |
| 109 | QSETQK | 2 | 1 | y4 | 0.8 | 360.68 | 505.26 | 16.3 | 2000 |
| 110 | QSETQK | 2 | 1 | y3 | 0.8 | 360.68 | 376.22 | 16.3 | 2000 |
| 111 | QSGGR | 2 | 1 | y4 | 0.7 | 252.63 | 376.19 | 10.1 | 2000 |
| 112 | QSGGR | 2 | 1 | y3 | 0.7 | 252.63 | 289.16 | 10.1 | 2000 |
| 113 | QSGGR | 2 | 2 | y4 | 0.7 | 252.63 | 188.6 | 10.1 | 2000 |
| 114 | SDLVNYNPIAEK | 2 | 1 | y8 | 17.3 | 681.85 | 948.48 | 34.6 | 2000 |
| 115 | SDLVNYNPIAEK | 2 | 1 | y6 | 17.4 | 681.85 | 671.37 | 34.6 | 2000 |
| 116 | SDLVNYNPIAEK | 2 | 1 | y5 | 17.4 | 681.85 | 557.33 | 34.6 | 2000 |
| 117 | SESEPNLLNQR | 2 | 1 | y7 | 14.6 | 643.82 | 854.48 | 32.4 | 2000 |
| 118 | SESEPNLLNQR | 2 | 2 | y7 | 14.6 | 643.82 | 427.75 | 32.4 | 2000 |
| 119 | SESEPNLLNQR | 3 | 1 | y3 | 14.6 | 429.55 | 417.22 | 20.4 | 2000 |
| 120 | SLGDETFR | 2 | 1 | y6 | 13.9 | 462.73 | 724.33 | 22.1 | 2000 |
| 121 | SLGDETFR | 2 | 1 | y5 | 13.8 | 462.73 | 667.31 | 22.1 | 2000 |
| 122 | SLGDETFR | 2 | 1 | y4 | 13.9 | 462.73 | 552.28 | 22.1 | 2000 |
| 123 | SSGGR | 2 | 1 | y4 | 0.7 | 232.12 | 376.19 | 9 | 2000 |
| 124 | SSGGR | 2 | 1 | y3 | 0.7 | 232.12 | 289.16 | 9 | 2000 |
| 125 | SSGGR | 2 | 2 | y4 | 0.7 | 232.12 | 188.6 | 9 | 2000 |

TABLE 38-continued

| Transition number | Peptide | Charge state of the precursor | Charge state of the fragment | Fragment ion | Retention time (minutes) | (m/z) filtered in Q1 | (m/z) filtered in Q3 | Collision energy (eV) | Positivity threshold |
|---|---|---|---|---|---|---|---|---|---|
| 126 | SWVVGDK | 2 | 1 | y5 | 13.9 | 395.71 | 517.3 | 18.3 | 2000 |
| 127 | SWVVGDK | 2 | 1 | y4 | 13.9 | 395.71 | 418.23 | 18.3 | 2000 |
| 128 | SWVVGDK | 2 | 1 | y3 | 13.9 | 395.71 | 319.16 | 18.3 | 2000 |
| 129 | TEPTLNTAIPGDPR | 2 | 2 | y12 | 16.3 | 741.38 | 626.34 | 38 | 2000 |
| 130 | TEPTLNTAIPGDPR | 2 | 1 | y5 | 16.3 | 741.38 | 541.27 | 38 | 2000 |
| 131 | TEPTLNTAIPGDPR | 3 | 1 | y5 | 16.3 | 494.59 | 541.27 | 22.4 | 2000 |
| 132 | TGSGDYGTTNDIAVIWPK | 2 | 1 | y8 | 20.9 | 947.96 | 941.55 | 49.8 | 2000 |
| 133 | TGSGDYGTTNDIAVIWPK | 3 | 2 | y6 | 21 | 632.31 | 357.22 | 26.7 | 2000 |
| 134 | TGSGDYGTTNDIAVIWPK | 3 | 2 | y5 | 20.9 | 632.31 | 321.7 | 26.7 | 2000 |
| 135 | TGSGDYGTTNDIAVIWPQGR | 3 | 1 | y6 | 20.5 | 703.34 | 756.42 | 28.9 | 2000 |
| 136 | TGSGDYGTTNDIAVIWPQGR | 3 | 1 | y5 | 20.5 | 703.34 | 643.33 | 28.9 | 2000 |
| 137 | TGSGDYGTTNDIAVIWPQGR | 3 | 1 | y4 | 20.5 | 703.34 | 457.25 | 28.9 | 2000 |
| 138 | TGSGGYGTTNDIAVIWPK | 2 | 1 | y3 | 20.9 | 918.96 | 430.25 | 48.1 | 2000 |
| 139 | TGSGGYGTTNDIAVIWPK | 3 | 1 | y6 | 20.9 | 612.98 | 713.43 | 26.1 | 2000 |
| 140 | TGSGGYGTTNDIAVIWPK | 3 | 1 | y5 | 20.9 | 612.98 | 642.4 | 26.1 | 2000 |
| 141 | VMAAAAVLK | 2 | 1 | y8 | 15.7 | 437.27 | 774.45 | 20.7 | 2000 |
| 142 | VMAAAAVLK | 2 | 1 | y7 | 15.7 | 437.27 | 643.41 | 20.7 | 2000 |
| 143 | VMAAAAVLK | 2 | 1 | y6 | 15.7 | 437.27 | 572.38 | 20.7 | 2000 |
| 144 | VMAVAAVLK | 2 | 1 | y7 | 18.2 | 451.28 | 671.45 | 21.5 | 2000 |
| 145 | VMAVAAVLK | 2 | 1 | y6 | 18.2 | 451.28 | 600.41 | 21.5 | 2000 |
| 146 | VMAVAAVLK | 2 | 1 | y5 | 18.2 | 451.28 | 501.34 | 21.5 | 2000 |
| 147 | VTAFAR | 2 | 1 | y5 | 11 | 332.69 | 565.31 | 14.7 | 2000 |
| 148 | VTAFAR | 2 | 1 | y4 | 11 | 332.69 | 464.26 | 14.7 | 2000 |
| 149 | VTAFAR | 2 | 1 | y3 | 11 | 332.69 | 393.22 | 14.7 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |

-continued

| | |
|---|---|
| Collision cell exit potential (CXP): | 15 V |
| Total cycle time: | 0.04 sec |
| Detection window: | 120 sec |

The areas obtained for each of the transitions and for each of the microorganisms studied were measured. When the areas of the transitions are greater than or equal to the positivity threshold described in TABLE 38, the detection of the transition is considered to be positive and is labelled "1" in TABLE 39. When a transition has an area less than the positivity threshold described in TABLE 38, the transition is considered non-detected and is labelled "0" in TABLE 39.

For a given peptide, when at least 3 transitions are labelled "1", the peptide is considered as being detected.

TABLE 39

| Transition number | Sam109 | Sam110 | Sam111 | Sam112 | Sam113 | Sam114 | Sam115 | Sam116 | Sam117 | Sam118 |
|---|---|---|---|---|---|---|---|---|---|---|
| 1 | 0 | 0 | 0 | 0 | 0 | 0 | 0 | 0 | 1 | 0 |
| 2 | 1 | 1 | 0 | 0 | 1 | 0 | 0 | 0 | 1 | 1 |
| 3 | 1 | 1 | 0 | 0 | 1 | 0 | 0 | 0 | 1 | 1 |
| 4 | 0 | 0 | 0 | 0 | 0 | 0 | 0 | 1 | 0 | 0 |
| 5 | 0 | 0 | 0 | 0 | 0 | 0 | 0 | 0 | 0 | 0 |
| 6 | 0 | 0 | 0 | 0 | 0 | 0 | 0 | 1 | 0 | 0 |
| 7 | 0 | 1 | 0 | 0 | 1 | 0 | 0 | 0 | 0 | 0 |
| 8 | 0 | 0 | 0 | 0 | 0 | 0 | 0 | 0 | 0 | 0 |
| 9 | 0 | 0 | 0 | 0 | 0 | 0 | 0 | 0 | 0 | 0 |
| 10 | 0 | 0 | 0 | 0 | 0 | 0 | 0 | 0 | 0 | 0 |
| 11 | 0 | 0 | 0 | 0 | 0 | 0 | 0 | 0 | 0 | 0 |
| 12 | 0 | 0 | 0 | 0 | 0 | 0 | 0 | 0 | 0 | 0 |
| 13 | 0 | 0 | 0 | 0 | 0 | 0 | 0 | 0 | 0 | 0 |
| 14 | 0 | 0 | 0 | 0 | 0 | 0 | 0 | 0 | 0 | 0 |
| 15 | 0 | 0 | 0 | 0 | 0 | 0 | 0 | 0 | 0 | 0 |
| 16 | 1 | 1 | 1 | 1 | 1 | 0 | 1 | 1 | 0 | 1 |
| 17 | 1 | 1 | 1 | 1 | 1 | 0 | 1 | 1 | 0 | 1 |
| 18 | 1 | 1 | 1 | 1 | 1 | 0 | 1 | 1 | 0 | 1 |
| 19 | 0 | 0 | 0 | 0 | 0 | 0 | 0 | 0 | 0 | 0 |
| 20 | 0 | 0 | 0 | 0 | 0 | 0 | 0 | 0 | 0 | 0 |
| 21 | 0 | 0 | 0 | 0 | 0 | 0 | 0 | 0 | 0 | 0 |
| 22 | 0 | 0 | 0 | 0 | 0 | 0 | 0 | 0 | 0 | 0 |
| 23 | 0 | 0 | 0 | 0 | 0 | 0 | 0 | 0 | 0 | 0 |
| 24 | 0 | 0 | 0 | 0 | 0 | 0 | 0 | 0 | 0 | 0 |
| 25 | 1 | 1 | 0 | 0 | 1 | 0 | 1 | 0 | 1 | 0 |
| 26 | 1 | 1 | 1 | 0 | 1 | 1 | 1 | 1 | 1 | 0 |
| 27 | 1 | 1 | 0 | 0 | 1 | 0 | 1 | 0 | 1 | 0 |
| 28 | 0 | 0 | 0 | 0 | 0 | 0 | 0 | 0 | 0 | 0 |
| 29 | 0 | 0 | 0 | 0 | 0 | 0 | 0 | 0 | 0 | 0 |
| 30 | 1 | 1 | 0 | 0 | 1 | 0 | 1 | 0 | 0 | 0 |
| 31 | 0 | 1 | 1 | 0 | 1 | 0 | 0 | 0 | 1 | 1 |
| 32 | 0 | 0 | 0 | 0 | 0 | 0 | 0 | 0 | 0 | 0 |
| 33 | 0 | 0 | 0 | 0 | 0 | 0 | 0 | 0 | 0 | 0 |
| 34 | 0 | 0 | 0 | 0 | 0 | 0 | 0 | 0 | 0 | 0 |
| 35 | 0 | 0 | 0 | 0 | 0 | 0 | 0 | 0 | 0 | 0 |
| 36 | 0 | 0 | 0 | 0 | 0 | 0 | 0 | 0 | 0 | 0 |
| 37 | 0 | 0 | 0 | 0 | 0 | 0 | 0 | 1 | 1 | 0 |
| 38 | 0 | 0 | 0 | 0 | 0 | 0 | 0 | 1 | 1 | 0 |
| 39 | 0 | 0 | 0 | 0 | 0 | 0 | 0 | 0 | 1 | 0 |
| 40 | 0 | 0 | 0 | 0 | 1 | 0 | 0 | 0 | 0 | 0 |
| 41 | 0 | 0 | 0 | 0 | 1 | 0 | 1 | 0 | 0 | 1 |
| 42 | 0 | 0 | 0 | 0 | 0 | 0 | 0 | 0 | 0 | 1 |
| 43 | 1 | 0 | 0 | 0 | 0 | 0 | 0 | 0 | 1 | 0 |
| 44 | 1 | 0 | 0 | 0 | 0 | 0 | 0 | 0 | 1 | 0 |
| 45 | 1 | 0 | 0 | 0 | 0 | 0 | 0 | 0 | 1 | 0 |
| 46 | 1 | 0 | 0 | 0 | 0 | 0 | 0 | 0 | 0 | 1 |
| 47 | 1 | 0 | 0 | 0 | 0 | 0 | 0 | 0 | 0 | 1 |
| 48 | 0 | 0 | 0 | 0 | 1 | 0 | 0 | 0 | 0 | 1 |
| 49 | 0 | 1 | 0 | 0 | 1 | 0 | 1 | 0 | 0 | 0 |
| 50 | 0 | 1 | 0 | 0 | 1 | 0 | 1 | 0 | 0 | 0 |
| 51 | 0 | 1 | 0 | 0 | 1 | 0 | 1 | 0 | 0 | 0 |
| 52 | 1 | 0 | 1 | 1 | 0 | 1 | 0 | 1 | 1 | 1 |
| 53 | 1 | 0 | 1 | 1 | 0 | 1 | 0 | 1 | 1 | 1 |
| 54 | 1 | 0 | 1 | 1 | 1 | 1 | 1 | 1 | 1 | 1 |
| 55 | 0 | 0 | 0 | 0 | 1 | 0 | 0 | 0 | 0 | 0 |
| 56 | 0 | 0 | 0 | 0 | 1 | 0 | 0 | 0 | 0 | 0 |
| 57 | 0 | 0 | 0 | 0 | 1 | 0 | 0 | 0 | 0 | 0 |
| 58 | 0 | 0 | 0 | 0 | 0 | 0 | 0 | 0 | 0 | 1 |
| 59 | 0 | 0 | 0 | 0 | 0 | 0 | 0 | 0 | 0 | 0 |
| 60 | 0 | 0 | 0 | 0 | 0 | 0 | 0 | 0 | 0 | 1 |
| 61 | 1 | 0 | 0 | 0 | 0 | 0 | 0 | 0 | 0 | 0 |
| 62 | 1 | 0 | 0 | 0 | 0 | 0 | 0 | 0 | 0 | 0 |
| 63 | 1 | 0 | 0 | 0 | 0 | 0 | 0 | 0 | 0 | 0 |
| 64 | 0 | 1 | 0 | 0 | 1 | 1 | 1 | 0 | 0 | 0 |
| 65 | 0 | 1 | 0 | 0 | 1 | 1 | 1 | 0 | 0 | 0 |
| 66 | 0 | 1 | 0 | 0 | 1 | 1 | 1 | 0 | 0 | 0 |
| 67 | 0 | 0 | 0 | 0 | 0 | 0 | 0 | 0 | 1 | 0 |
| 68 | 0 | 0 | 0 | 0 | 0 | 0 | 0 | 0 | 1 | 0 |
| 69 | 0 | 0 | 0 | 0 | 0 | 0 | 0 | 0 | 1 | 0 |
| 70 | 0 | 0 | 0 | 0 | 0 | 0 | 0 | 0 | 0 | 0 |
| 71 | 0 | 0 | 0 | 0 | 0 | 1 | 0 | 0 | 1 | 0 |
| 72 | 0 | 0 | 0 | 0 | 0 | 0 | 0 | 0 | 1 | 0 |
| 73 | 1 | 1 | 0 | 0 | 1 | 1 | 0 | 0 | 0 | 1 |
| 74 | 1 | 1 | 0 | 1 | 1 | 1 | 1 | 0 | 0 | 0 |
| 75 | 1 | 1 | 0 | 0 | 1 | 1 | 1 | 0 | 0 | 1 |
| 76 | 0 | 0 | 1 | 1 | 0 | 0 | 0 | 1 | 0 | 1 |
| 77 | 0 | 0 | 1 | 1 | 0 | 0 | 0 | 1 | 0 | 1 |

TABLE 39-continued

| Transition number | Sam109 | Sam110 | Sam111 | Sam112 | Sam113 | Sam114 | Sam115 | Sam116 | Sam117 | Sam118 |
|---|---|---|---|---|---|---|---|---|---|---|
| 78 | 0 | 0 | 1 | 1 | 0 | 0 | 0 | 1 | 0 | 1 |
| 79 | 0 | 0 | 0 | 0 | 0 | 0 | 0 | 0 | 0 | 0 |
| 80 | 0 | 0 | 0 | 0 | 0 | 0 | 0 | 0 | 0 | 0 |
| 81 | 0 | 0 | 0 | 0 | 0 | 0 | 0 | 0 | 0 | 0 |
| 82 | 0 | 0 | 0 | 0 | 0 | 0 | 0 | 0 | 0 | 0 |
| 83 | 0 | 0 | 0 | 0 | 0 | 0 | 0 | 0 | 0 | 0 |
| 84 | 0 | 0 | 0 | 0 | 0 | 0 | 0 | 0 | 0 | 0 |
| 85 | 0 | 0 | 0 | 0 | 0 | 0 | 0 | 0 | 0 | 0 |
| 86 | 0 | 0 | 0 | 0 | 0 | 0 | 0 | 0 | 0 | 0 |
| 87 | 1 | 0 | 0 | 0 | 0 | 1 | 0 | 0 | 1 | 0 |
| 88 | 1 | 0 | 0 | 0 | 0 | 1 | 0 | 0 | 1 | 0 |
| 89 | 1 | 0 | 0 | 0 | 0 | 1 | 1 | 0 | 1 | 0 |
| 90 | 0 | 0 | 0 | 0 | 0 | 1 | 0 | 0 | 0 | 0 |
| 91 | 0 | 0 | 0 | 0 | 0 | 1 | 1 | 0 | 0 | 0 |
| 92 | 0 | 0 | 0 | 0 | 0 | 1 | 1 | 0 | 0 | 0 |
| 93 | 0 | 0 | 0 | 0 | 0 | 0 | 0 | 0 | 0 | 0 |
| 94 | 0 | 0 | 0 | 0 | 0 | 0 | 0 | 1 | 0 | 0 |
| 95 | 0 | 0 | 0 | 0 | 0 | 0 | 0 | 0 | 0 | 0 |
| 96 | 0 | 0 | 0 | 0 | 0 | 0 | 0 | 0 | 0 | 0 |
| 97 | 0 | 0 | 0 | 0 | 0 | 0 | 0 | 0 | 0 | 0 |
| 98 | 0 | 0 | 0 | 0 | 0 | 0 | 0 | 0 | 0 | 0 |
| 99 | 0 | 0 | 0 | 0 | 0 | 0 | 0 | 0 | 0 | 0 |
| 100 | 0 | 0 | 0 | 0 | 0 | 0 | 0 | 0 | 1 | 0 |
| 101 | 0 | 0 | 0 | 0 | 0 | 0 | 0 | 0 | 0 | 0 |
| 102 | 0 | 1 | 0 | 0 | 1 | 0 | 1 | 0 | 0 | 0 |
| 103 | 0 | 1 | 0 | 0 | 1 | 1 | 1 | 1 | 0 | 1 |
| 104 | 0 | 1 | 0 | 0 | 1 | 1 | 1 | 0 | 0 | 0 |
| 105 | 0 | 0 | 0 | 0 | 0 | 0 | 0 | 0 | 0 | 0 |
| 106 | 0 | 0 | 0 | 0 | 0 | 0 | 0 | 0 | 0 | 0 |
| 107 | 0 | 0 | 0 | 0 | 0 | 0 | 0 | 0 | 0 | 0 |
| 108 | 0 | 0 | 0 | 0 | 0 | 0 | 0 | 0 | 0 | 0 |
| 109 | 0 | 0 | 0 | 0 | 0 | 0 | 0 | 0 | 0 | 0 |
| 110 | 0 | 0 | 0 | 0 | 0 | 0 | 0 | 0 | 0 | 0 |
| 111 | 0 | 0 | 0 | 0 | 0 | 0 | 0 | 0 | 0 | 0 |
| 112 | 0 | 0 | 0 | 0 | 0 | 0 | 0 | 0 | 0 | 0 |
| 113 | 0 | 0 | 0 | 0 | 0 | 0 | 0 | 0 | 0 | 0 |
| 114 | 0 | 0 | 1 | 1 | 0 | 0 | 0 | 1 | 1 | 1 |
| 115 | 0 | 1 | 1 | 1 | 0 | 0 | 0 | 1 | 1 | 1 |
| 116 | 0 | 0 | 1 | 1 | 0 | 0 | 0 | 1 | 1 | 1 |
| 117 | 0 | 0 | 0 | 0 | 0 | 0 | 0 | 0 | 0 | 1 |
| 118 | 0 | 0 | 0 | 0 | 0 | 0 | 0 | 0 | 0 | 1 |
| 119 | 0 | 0 | 0 | 1 | 0 | 0 | 0 | 0 | 0 | 1 |
| 120 | 0 | 0 | 0 | 0 | 0 | 0 | 0 | 0 | 0 | 0 |
| 121 | 0 | 0 | 0 | 0 | 0 | 0 | 0 | 0 | 0 | 0 |
| 122 | 0 | 0 | 0 | 0 | 0 | 0 | 0 | 0 | 0 | 0 |
| 123 | 0 | 0 | 0 | 0 | 0 | 0 | 0 | 0 | 0 | 0 |
| 124 | 0 | 0 | 0 | 0 | 0 | 0 | 0 | 0 | 0 | 0 |
| 125 | 0 | 0 | 0 | 0 | 0 | 0 | 0 | 0 | 0 | 0 |
| 126 | 0 | 0 | 0 | 0 | 0 | 0 | 0 | 0 | 0 | 0 |
| 127 | 0 | 0 | 0 | 0 | 0 | 0 | 0 | 0 | 0 | 0 |
| 128 | 0 | 0 | 0 | 0 | 0 | 0 | 0 | 0 | 0 | 0 |
| 129 | 1 | 1 | 0 | 1 | 1 | 1 | 1 | 1 | 1 | 1 |
| 130 | 1 | 1 | 0 | 1 | 1 | 1 | 1 | 1 | 1 | 1 |
| 131 | 1 | 1 | 0 | 1 | 1 | 1 | 1 | 1 | 1 | 1 |
| 132 | 0 | 0 | 0 | 0 | 0 | 0 | 0 | 0 | 0 | 0 |
| 133 | 0 | 0 | 0 | 0 | 0 | 0 | 0 | 0 | 0 | 0 |
| 134 | 0 | 0 | 0 | 0 | 0 | 0 | 0 | 0 | 0 | 0 |
| 135 | 1 | 1 | 0 | 0 | 1 | 0 | 1 | 0 | 0 | 0 |
| 136 | 1 | 1 | 1 | 0 | 1 | 0 | 1 | 0 | 0 | 0 |
| 137 | 0 | 1 | 0 | 0 | 1 | 0 | 1 | 0 | 0 | 0 |
| 138 | 0 | 0 | 0 | 1 | 0 | 0 | 0 | 0 | 0 | 1 |
| 139 | 1 | 0 | 0 | 1 | 0 | 0 | 0 | 0 | 0 | 1 |
| 140 | 1 | 0 | 0 | 0 | 0 | 0 | 0 | 0 | 0 | 1 |
| 141 | 1 | 1 | 0 | 1 | 1 | 1 | 1 | 1 | 1 | 1 |
| 142 | 1 | 1 | 0 | 1 | 1 | 1 | 1 | 1 | 1 | 1 |
| 143 | 1 | 1 | 0 | 1 | 1 | 1 | 1 | 1 | 1 | 1 |
| 144 | 0 | 0 | 1 | 0 | 0 | 0 | 0 | 0 | 0 | 0 |
| 145 | 0 | 0 | 1 | 0 | 0 | 0 | 0 | 0 | 0 | 0 |
| 146 | 0 | 0 | 1 | 0 | 0 | 0 | 0 | 0 | 0 | 0 |
| 147 | 0 | 0 | 0 | 0 | 0 | 0 | 0 | 0 | 0 | 0 |
| 148 | 0 | 0 | 0 | 0 | 0 | 0 | 0 | 0 | 0 | 0 |
| 149 | 0 | 0 | 0 | 0 | 0 | 0 | 0 | 0 | 0 | 0 |

Samples Sam109 to Sam118 comprise at least one peptide which is characteristic of the CTX-M proteins. The bacteria present in samples Sam109 to Sam118 therefore express a beta-lactamase which confers on them a resistance to penicillins, to cephalosporins and to monobactams.

EXAMPLE 28

Identification of a Resistance to DHA Beta-Lactams

Samples Sam119 to Sam124 are identified according to one of the methods described in examples 1, 3 or 4. The identification of the species is set out in TABLE 40.

TABLE 40

| Names | Species |
|---|---|
| Sam119 | E. coli |
| Sam120 | K. oxytoca |
| Sam121 | K. pneumoniae |
| Sam122 | K. pneumoniae |
| Sam123 | K. pneumoniae |
| Sam124 | K. pneumoniae |

Samples Sam119 to Sam124 correspond to a species able to comprise a DHA resistance mechanism. Each sample is treated according to example 5, then analysed according to example 6 by detecting the peptides from TABLE 41 instead of the peptides from TABLE 3.

TABLE 41

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 1 | AAQAILSALEMK | 2 | y8 monocharged | 21.45 | 623.35 | 904.52 | 31.3 | 2500 |
| 2 | AAQAILSALEMK | 2 | y7 monocharged | 21.45 | 623.35 | 791.43 | 31.3 | 2500 |
| 3 | AAQAILSALEMK | 2 | y6 monocharged | 21.45 | 623.35 | 678.35 | 31.3 | 2500 |
| 4 | ADLLNFYQQWQPSR | 2 | y3 monocharged | 22.92 | 883.44 | 359.2 | 46.1 | 2500 |
| 5 | ADLLNFYQQWQPSR | 3 | y5 monocharged | 22.92 | 589.29 | 673.34 | 25.4 | 2500 |
| 6 | ADLLNFYQQWQPSR | 3 | y3 monocharged | 22.92 | 589.29 | 359.2 | 25.4 | 2500 |
| 7 | AGNADLEMAMYLAQTR | 3 | y6 monocharged | 21.53 | 585.61 | 751.41 | 25.2 | 2500 |
| 8 | AGNADLEMAMYLAQTR | 3 | y5 monocharged | 21.53 | 585.61 | 588.35 | 25.2 | 2500 |
| 9 | AGNADLEMAMYLAQTR | 3 | y4 monocharged | 21.53 | 585.61 | 475.26 | 25.2 | 2500 |
| 10 | EMALNDPAAK | 2 | y8 monocharged | 13.12 | 530.26 | 799.43 | 26 | 2500 |
| 11 | EMALNDPAAK | 2 | y6 monocharged | 13.12 | 530.26 | 615.31 | 26 | 2500 |
| 12 | EMALNDPAAK | 2 | y4 monocharged | 13.12 | 530.26 | 386.24 | 26 | 2500 |
| 13 | GKPYYFNYGFADIQAK | 3 | y8 monocharged | 19.85 | 627.98 | 849.45 | 26.5 | 2500 |
| 14 | GKPYYFNYGFADIQAK | 3 | y6 monocharged | 19.85 | 627.98 | 645.36 | 26.5 | 2500 |
| 15 | GKPYYFNYGFADIQAK | 3 | y5 monocharged | 19.85 | 627.98 | 574.32 | 26.5 | 2500 |
| 16 | NYPNTER | 2 | y5 monocharged | 7.63 | 447.21 | 616.31 | 21.2 | 2500 |
| 17 | NYPNTER | 2 | y3 monocharged | 7.63 | 447.21 | 405.21 | 21.2 | 2500 |
| 18 | NYPNTER | 2 | y5 dicharged | 7.63 | 447.21 | 308.66 | 21.2 | 2500 |
| 19 | QPVTENTLFELGSVSK | 2 | y8 monocharged | 20.9 | 874.96 | 866.46 | 45.6 | 2500 |
| 20 | QPVTENTLFELGSVSK | 3 | y8 monocharged | 20.9 | 583.64 | 866.46 | 25.2 | 2500 |
| 21 | QPVTENTLFELGSVSK | 3 | y5 monocharged | 20.9 | 583.64 | 477.27 | 25.2 | 2500 |
| 22 | QVAIVILANK | 2 | y8 monocharged | 18.75 | 534.84 | 841.55 | 26.2 | 2500 |
| 23 | QVAIVILANK | 2 | y6 monocharged | 18.75 | 534.84 | 657.43 | 26.2 | 2500 |
| 24 | QVAIVILANK | 2 | y5 monocharged | 18.75 | 534.84 | 558.36 | 26.2 | 2500 |
| 25 | TFTGVLGAVSVAK | 2 | y11 monocharged | 20.03 | 625.36 | 1001.6 | 31.4 | 2500 |
| 26 | TFTGVLGAVSVAK | 2 | y8 monocharged | 20.03 | 625.36 | 744.46 | 31.4 | 2500 |
| 27 | TFTGVLGAVSVAK | 2 | y7 monocharged | 20.03 | 625.36 | 631.38 | 31.4 | 2500 |
| 28 | TGATTGFGAYVAFIPEK | 2 | y3 monocharged | 22.12 | 865.44 | 373.21 | 45.1 | 2500 |

TABLE 41-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 29 | TGATTGFGAYVAFIPEK | 3 | y6 monocharged | 22.12 | 577.3 | 704.4 | 25 | 2500 |
| 30 | TGATTGFGAYVAFIPEK | 3 | y3 monocharged | 22.12 | 577.3 | 373.21 | 25 | 2500 |
| 31 | VSPGQLDAESYGVK | 2 | y8 monocharged | 15.43 | 725.37 | 868.41 | 37.1 | 2500 |
| 32 | VSPGQLDAESYGVK | 2 | y13 dicharged | 15.43 | 725.37 | 675.83 | 37.1 | 2500 |
| 33 | VSPGQLDAESYGVK | 2 | y12 dicharged | 15.43 | 725.37 | 632.31 | 37.1 | 2500 |
| 34 | WAEMNMEPSR | 2 | y8 monocharged | 15.78 | 625.77 | 993.41 | 31.4 | 2500 |
| 35 | WAEMNMEPSR | 2 | y6 monocharged | 15.78 | 625.77 | 733.33 | 31.4 | 2500 |
| 36 | WAEMNMEPSR | 2 | y3 monocharged | 15.78 | 625.77 | 359.2 | 31.4 | 2500 |
| 37 | YQPELALPQWK | 2 | y4 monocharged | 20.97 | 686.87 | 558.3 | 34.9 | 2500 |
| 38 | YQPELALPQWK | 2 | y9 dicharged | 20.97 | 686.87 | 541.31 | 34.9 | 2500 |
| 39 | YQPELALPQWK | 3 | y4 monocharged | 20.97 | 458.25 | 558.3 | 21.3 | 2500 |

The other machine parameters used are as follows:

| Scan type: | MRM |
|---|---|
| MRM planned: | no |
| Polarity: | Positive |
| Ionising source: | Turbo V™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1.17 sec |

The areas obtained for each of the transitions and for each of the microorganisms studied were measured. When the areas of the transitions are greater than or equal to the positivity threshold described in TABLE 41, the detection of the transition is considered to be positive and is labelled "1" in TABLE 42. When a transition has an area less than the positivity threshold described in TABLE 41, the transition is considered non-detected and is labelled "0" in TABLE 42.

For a given peptide, when at least 3 transitions are labelled "1", the peptide is considered as being detected.

TABLE 42

| Transition number | Sam119 | Sam120 | Sam121 | Sam122 | Sam123 | Sam124 |
|---|---|---|---|---|---|---|
| 1 | 1 | 0 | 1 | 1 | 0 | 0 |
| 2 | 0 | 0 | 0 | 0 | 0 | 0 |
| 3 | 0 | 0 | 0 | 0 | 0 | 0 |
| 4 | 0 | 0 | 1 | 0 | 1 | 0 |
| 5 | 0 | 1 | 1 | 0 | 0 | 0 |
| 6 | 0 | 1 | 1 | 0 | 0 | 0 |
| 7 | 0 | 0 | 0 | 1 | 0 | 0 |
| 8 | 0 | 0 | 0 | 1 | 0 | 0 |
| 9 | 0 | 0 | 0 | 1 | 0 | 0 |
| 10 | 1 | 1 | 1 | 1 | 1 | 1 |
| 11 | 1 | 1 | 1 | 1 | 1 | 1 |
| 12 | 1 | 1 | 1 | 0 | 1 | 1 |
| 13 | 1 | 1 | 1 | 0 | 1 | 0 |
| 14 | 1 | 1 | 1 | 0 | 1 | 0 |
| 15 | 1 | 0 | 1 | 0 | 0 | 0 |
| 16 | 0 | 0 | 1 | 1 | 0 | 1 |
| 17 | 0 | 0 | 1 | 1 | 0 | 1 |
| 18 | 0 | 0 | 1 | 1 | 1 | 1 |
| 19 | 1 | 1 | 1 | 1 | 1 | 1 |
| 20 | 1 | 0 | 1 | 1 | 1 | 1 |
| 21 | 1 | 1 | 1 | 1 | 1 | 1 |
| 22 | 0 | 1 | 1 | 1 | 1 | 1 |
| 23 | 0 | 0 | 1 | 1 | 1 | 1 |
| 24 | 1 | 1 | 1 | 1 | 1 | 1 |
| 25 | 1 | 1 | 1 | 1 | 1 | 1 |
| 26 | 1 | 1 | 1 | 1 | 1 | 1 |
| 27 | 1 | 1 | 1 | 1 | 1 | 1 |
| 28 | 0 | 0 | 1 | 1 | 0 | 0 |
| 29 | 0 | 0 | 1 | 1 | 1 | 0 |
| 30 | 0 | 0 | 1 | 1 | 0 | 0 |
| 31 | 1 | 1 | 1 | 1 | 1 | 1 |
| 32 | 0 | 1 | 1 | 1 | 1 | 1 |
| 33 | 0 | 1 | 1 | 1 | 1 | 1 |
| 34 | 1 | 1 | 1 | 1 | 1 | 1 |
| 35 | 0 | 1 | 1 | 1 | 1 | 1 |
| 36 | 1 | 0 | 1 | 1 | 1 | 1 |
| 37 | 1 | 0 | 1 | 1 | 0 | 1 |
| 38 | 1 | 1 | 1 | 1 | 1 | 1 |
| 39 | 1 | 1 | 1 | 1 | 1 | 1 |

Samples 119 to Sam124 comprise at least one peptide which is characteristic of the DHA proteins. The bacteria present in samples Sam119 to Sam124 therefore express a beta-lactamase which confers on them a resistance to penicillins and to cephalosporins, with the exception of fourth-generation cephalosporins.

EXAMPLE 29

Identification of a Resistance to FOX Beta-Lactams

Samples Sam125 to Sam130 are identified according to one of the methods described in examples 1, 3 or 4. The identification of the species is set out in TABLE 43.

TABLE 43

| Names | Species |
|---|---|
| Sam125 | E. coli |
| Sam126 | E. coli |

TABLE 43-continued

| Names | Species |
|---|---|
| Sam127 | K. oxytoca |
| Sam128 | K. oxytoca |
| Sam129 | K. pneumoniae |
| Sam13 | K. pneumoniae |

Samples Sam125 to Sam130 correspond to a species able to comprise a FOX resistance mechanism. Each sample is treated according to example 5, then analysed according to example 6 by detecting the peptides from TABLE 44 instead of the peptides from TABLE 3.

TABLE 44

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 1 | AHYFNYGVANR | 3 | y3 monocharged | 14.08 | 437.88 | 360.2 | 20.7 | 2500 |
| 2 | AHYFNYGVANR | 3 | y4 monocharged | 14.08 | 437.88 | 459.27 | 20.7 | 2500 |
| 3 | AHYFNYGVANR | 3 | y5 monocharged | 14.08 | 437.88 | 516.29 | 20.7 | 2500 |
| 4 | AMGEQR | 2 | y5 dicharged | 1.08 | 346.16 | 310.65 | 15.5 | 2500 |
| 5 | AMGEQR | 2 | y4 monocharged | 1.08 | 346.16 | 489.24 | 15.5 | 2500 |
| 6 | AMGEQR | 2 | y5 monocharged | 1.08 | 346.16 | 620.28 | 15.5 | 2500 |
| 7 | ESGQR | 2 | y3 dicharged | 0.8 | 288.64 | 180.6 | 12.2 | 2500 |
| 8 | ESGQR | 2 | y3 monocharged | 0.76 | 288.64 | 360.2 | 12.2 | 2500 |
| 9 | ESGQR | 2 | y4 monocharged | 0.82 | 288.64 | 447.23 | 12.2 | 2500 |
| 10 | FAVPK | 3 | y4 monocharged | 12.95 | 187.79 | 414.27 | 12.9 | 2500 |
| 11 | FAVPK | 2 | y3 monocharged | 12.95 | 281.17 | 343.23 | 11.8 | 2500 |
| 12 | FAVPK | 2 | y4 monocharged | 12.93 | 281.17 | 414.27 | 11.8 | 2500 |
| 13 | GGFELDDK | 2 | y6 dicharged | 14.31 | 440.71 | 383.69 | 20.9 | 2500 |
| 14 | GGFELDDK | 2 | y4 monocharged | 14.34 | 440.71 | 490.25 | 20.9 | 2500 |
| 15 | GGFELDDK | 2 | y5 monocharged | 14.31 | 440.71 | 619.29 | 20.9 | 2500 |
| 16 | GIAIVMLANR | 2 | y4 monocharged | 20.15 | 529.31 | 473.28 | 25.9 | 2500 |
| 17 | GIAIVMLANR | 2 | y5 monocharged | 20.13 | 529.31 | 604.32 | 25.9 | 2500 |
| 18 | GIAIVMLANR | 2 | y6 monocharged | 20.13 | 529.31 | 703.39 | 25.9 | 2500 |
| 19 | IPGMAVAVLK | 2 | y9 dicharged | 19.17 | 499.81 | 443.27 | 24.2 | 2500 |
| 20 | IPGMAVAVLK | 2 | y8 monocharged | 19.17 | 499.81 | 788.47 | 24.2 | 2500 |
| 21 | IPGMAVAVLK | 2 | y9 monocharged | 19.15 | 499.81 | 885.52 | 24.2 | 2500 |
| 22 | NYPIEAR | 2 | y3 monocharged | 12.04 | 431.73 | 375.2 | 20.3 | 2500 |
| 23 | NYPIEAR | 2 | y4 monocharged | 12.04 | 431.73 | 488.28 | 20.3 | 2500 |
| 24 | NYPIEAR | 2 | y5 monocharged | 12.06 | 431.73 | 585.34 | 20.3 | 2500 |
| 25 | SWSPVYPAGTHR | 3 | y9 dicharged | 14.97 | 453.23 | 499.26 | 21.1 | 2500 |
| 26 | SWSPVYPAGTHR | 3 | y10 dicharged | 14.97 | 453.23 | 542.78 | 21.1 | 2500 |
| 27 | SWSPVYPAGTHR | 3 | y6 monocharged | 14.97 | 453.23 | 638.34 | 21.1 | 2500 |
| 28 | TGSADLLK | 2 | y5 monocharged | 12.97 | 402.73 | 559.35 | 18.7 | 2500 |
| 29 | TGSADLLK | 2 | y6 monocharged | 12.95 | 402.73 | 646.38 | 18.7 | 2500 |

TABLE 44-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 30 | TGSADLLK | 2 | y7 monocharged | 12.97 | 402.73 | 703.4 | 18.7 | 2500 |
| 31 | TGSTGGFGAYVAFVPAR | 3 | y5 monocharged | 21.03 | 553.28 | 589.35 | 24.2 | 2500 |
| 32 | TGSTGGFGAYVAFVPAR | 3 | y6 monocharged | 21.03 | 553.28 | 660.38 | 24.2 | 2500 |
| 33 | TGSTGGFGAYVAFVPAR | 2 | y3 monocharged | 21.03 | 829.42 | 343.21 | 43 | 2500 |
| 34 | TGSTGGFGAYVAFVPAR | 2 | y6 monocharged | 21.03 | 829.42 | 660.38 | 43 | 2500 |
| 35 | TLTATLGAYAAVK | 2 | y7 monocharged | 18.68 | 640.37 | 679.38 | 32.2 | 2500 |
| 36 | TLTATLGAYAAVK | 2 | y8 monocharged | 18.68 | 640.37 | 792.46 | 32.2 | 2500 |
| 37 | TLTATLGAYAAVK | 2 | y9 monocharged | 18.66 | 640.37 | 893.51 | 32.2 | 2500 |
| 38 | VSEQTLFEIGSVSK | 2 | y5 monocharged | 20.34 | 762.4 | 477.27 | 39.2 | 2500 |
| 39 | VSEQTLFEIGSVSK | 2 | y7 monocharged | 20.34 | 762.4 | 719.39 | 39.2 | 2500 |
| 40 | VSEQTLFEIGSVSK | 2 | y8 monocharged | 20.34 | 762.4 | 866.46 | 39.2 | 2500 |
| 41 | VSQHAPWLK | 3 | y6 dicharged | 14.1 | 355.87 | 376.22 | 18.1 | 2500 |
| 42 | VSQHAPWLK | 3 | y8 dicharged | 14.1 | 355.87 | 483.76 | 18.1 | 2500 |
| 43 | VSQHAPWLK | 3 | y4 monocharged | 14.1 | 355.87 | 543.33 | 18.1 | 2500 |
| 44 | VTPGVLAAEAYGIK | 2 | y12 dicharged | 19.37 | 694.89 | 594.84 | 35.3 | 2500 |
| 45 | VTPGVLAAEAYGIK | 2 | y7 monocharged | 19.37 | 694.89 | 751.4 | 35.3 | 2500 |
| 46 | VTPGVLAAEAYGIK | 2 | y8 monocharged | 19.37 | 694.89 | 822.44 | 35.3 | 2500 |

The other machine parameters used are as follows:

| Scan type: | MRM |
|---|---|
| MRM planned: | no |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1.38 sec |

The areas obtained for each of the transitions and for each of the microorganisms studied were measured. When the areas of the transitions are greater than or equal to the positivity threshold described in TABLE 44, the detection of the transition is considered to be positive and is labelled "1" in TABLE 45. When a transition has an area less than the positivity threshold described in TABLE 44, the transition is considered non-detected and is labelled "0" in TABLE 45.

For a given peptide, when at least 2 transitions are labelled "1", the peptide is considered as being detected.

TABLE 45

| transition number | Sam125 | Sam126 | Sam127 | Sam128 | Sam129 | Sam130 |
|---|---|---|---|---|---|---|
| 1 | 0 | 0 | 1 | 1 | 0 | 0 |
| 2 | 1 | 0 | 1 | 1 | 0 | 0 |
| 3 | 1 | 1 | 1 | 1 | 0 | 1 |
| 4 | 1 | 1 | 0 | 1 | 1 | 1 |
| 5 | 1 | 1 | 0 | 1 | 1 | 1 |
| 6 | 1 | 1 | 1 | 1 | 1 | 1 |
| 7 | 0 | 0 | 0 | 0 | 0 | 0 |
| 8 | 0 | 0 | 1 | 0 | 0 | 0 |
| 9 | 0 | 0 | 0 | 0 | 0 | 0 |
| 10 | 0 | 0 | 0 | 0 | 0 | 0 |
| 11 | 0 | 0 | 0 | 0 | 0 | 0 |
| 12 | 0 | 0 | 0 | 0 | 0 | 0 |
| 13 | 1 | 1 | 1 | 1 | 1 | 1 |
| 14 | 1 | 0 | 0 | 1 | 0 | 1 |
| 15 | 1 | 0 | 0 | 1 | 0 | 1 |
| 16 | 1 | 0 | 1 | 1 | 1 | 1 |
| 17 | 1 | 1 | 1 | 1 | 1 | 1 |
| 18 | 1 | 1 | 1 | 1 | 1 | 1 |
| 19 | 1 | 1 | 1 | 1 | 1 | 1 |
| 20 | 1 | 1 | 1 | 1 | 1 | 1 |
| 21 | 1 | 1 | 1 | 1 | 1 | 1 |
| 22 | 1 | 1 | 1 | 1 | 1 | 1 |
| 23 | 1 | 1 | 1 | 1 | 1 | 1 |
| 24 | 1 | 1 | 1 | 1 | 1 | 1 |
| 25 | 1 | 1 | 1 | 1 | 1 | 1 |
| 26 | 1 | 1 | 1 | 1 | 1 | 1 |
| 27 | 1 | 1 | 1 | 1 | 1 | 1 |
| 28 | 1 | 1 | 1 | 1 | 1 | 1 |
| 29 | 1 | 1 | 1 | 1 | 1 | 1 |
| 30 | 1 | 1 | 1 | 1 | 1 | 1 |
| 31 | 1 | 0 | 1 | 1 | 1 | 1 |
| 32 | 0 | 1 | 1 | 1 | 1 | 1 |
| 33 | 0 | 1 | 1 | 0 | 1 | 1 |

TABLE 45-continued

| transition number | Sam125 | Sam126 | Sam127 | Sam128 | Sam129 | Sam130 |
|---|---|---|---|---|---|---|
| 34 | 0 | 1 | 1 | 1 | 1 | 1 |
| 35 | 0 | 0 | 0 | 0 | 0 | 1 |
| 36 | 1 | 1 | 1 | 0 | 1 | 1 |
| 37 | 1 | 0 | 1 | 0 | 1 | 1 |
| 38 | 1 | 1 | 1 | 1 | 1 | 1 |
| 39 | 1 | 1 | 1 | 1 | 1 | 1 |
| 40 | 1 | 1 | 1 | 1 | 1 | 1 |
| 41 | 1 | 1 | 1 | 1 | 1 | 1 |
| 42 | 1 | 1 | 0 | 0 | 1 | 1 |
| 43 | 1 | 1 | 1 | 1 | 1 | 1 |
| 44 | 0 | 0 | 0 | 0 | 0 | 0 |
| 45 | 0 | 0 | 0 | 0 | 0 | 0 |
| 46 | 0 | 0 | 0 | 0 | 0 | 0 |

Samples Sam125 to Sam130 comprise at least one peptide which is characteristic of the FOX proteins. The bacteria present in samples Sam125 to Sam130 therefore express a beta-lactamase which confers on them a resistance to penicillins and to cephalosporins, with the exception of fourth-generation cephalosporins.

EXAMPLE 30

Identification of a Resistance to SHV Beta-Lactams

Samples Sam131 to Sam144 are identified according to one of the methods described in examples 1, 3 or 4. The identification of the species is set out in TABLE 46.

TABLE 46

| Names | Species |
|---|---|
| Sam131 | E. aerogenes |
| Sam132 | E. coli |
| Sam133 | E. coli |
| Sam134 | E. coli |
| Sam135 | E. coli |
| Sam136 | K. pneumoniae |
| Sam137 | K. pneumoniae |
| Sam138 | K. pneumoniae |
| Sam139 | K. pneumoniae |
| Sam140 | K. pneumoniae |
| Sam141 | K. pneumoniae |
| Sam142 | K. pneumoniae |
| Sam143 | K. pneumoniae |
| Sam144 | K. pneumoniae |

Samples Sam131 to Sam144 correspond to a species able to comprise an SHV resistance mechanism. Each sample is treated according to example 5, then analysed according to example 6 by detecting the peptides from TABLE 47 instead of the peptides from TABLE 3.

TABLE 47

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 1 | AGAGER | 2 | y3 monocharged | 0.9 | 280.64 | 361.18 | 11.7 | 2000 |
| 2 | AGAGER | 2 | y4 monocharged | 0.9 | 280.64 | 432.22 | 11.7 | 2000 |
| 3 | AGAGER | 2 | y5 monocharged | 0.9 | 280.64 | 489.24 | 11.7 | 2000 |
| 4 | ATTTPASMAATLR | 3 | y5 monocharged | 16.2 | 431.23 | 531.33 | 20.5 | 2000 |
| 5 | ATTTPASMAATLR | 2 | y9 dicharged | 16.2 | 646.34 | 459.25 | 32.6 | 2000 |
| 6 | ATTTPASMAATLR | 2 | y9 monocharged | 16.2 | 646.34 | 917.49 | 32.6 | 2000 |
| 7 | CIISLLATLPLAVHASPQPLEQIK | 3 | y18 dicharged | 27.4 | 871.5 | 957.05 | 34.1 | 2000 |
| 8 | CIISLLATLPLAVHASPQPLEQIK | 3 | y21 dicharged | 27.4 | 871.5 | 1113.65 | 34.1 | 2000 |
| 9 | CIISLLATLPLAVHASPQPLEQIK | 3 | y22 dicharged | 27.3 | 871.5 | 1170.19 | 34.1 | 2000 |
| 10 | DMPASMAER | 2 | y7 dicharged | 12.4 | 504.22 | 381.18 | 24.5 | 2000 |
| 11 | DMPASMAER | 2 | y5 monocharged | 12.4 | 504.22 | 593.27 | 24.5 | 2000 |
| 12 | DMPASMAER | 2 | y7 monocharged | 12.4 | 504.22 | 761.36 | 24.5 | 2000 |
| 13 | DSPASMAER | 2 | y7 dicharged | 10.5 | 482.21 | 381.18 | 23.2 | 2000 |
| 14 | DSPASMAER | 2 | y5 monocharged | 10.5 | 482.21 | 593.27 | 23.2 | 2000 |
| 15 | DSPASMAER | 2 | y6 monocharged | 10.5 | 482.21 | 664.31 | 23.2 | 2000 |
| 16 | DTLASMAER | 2 | y5 monocharged | 14 | 497.24 | 593.27 | 24.1 | 2000 |
| 17 | DTLASMAER | 2 | y6 monocharged | 14 | 497.24 | 664.31 | 24.1 | 2000 |
| 18 | DTLASMAER | 2 | y7 monocharged | 14 | 497.24 | 777.39 | 24.1 | 2000 |
| 19 | DTPASMAER | 2 | y7 dicharged | 10.5 | 489.22 | 381.18 | 23.6 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 20 | DTPASMAER | 2 | y5 monocharged | 10.5 | 489.22 | 593.27 | 23.6 | 2000 |
| 21 | DTPASMAER | 2 | y7 monocharged | 10.5 | 489.22 | 761.36 | 23.6 | 2000 |
| 22 | DTPASMAK | 2 | y6 dicharged | 9.1 | 410.7 | 302.66 | 19.1 | 2000 |
| 23 | DTPASMAK | 2 | y5 monocharged | 9.1 | 410.7 | 507.26 | 19.1 | 2000 |
| 24 | DTPASMAK | 2 | y6 monocharged | 9.1 | 410.7 | 604.31 | 19.1 | 2000 |
| 25 | DTTTPASMAATLR | 3 | y5 monocharged | 16.5 | 445.89 | 531.33 | 20.9 | 2000 |
| 26 | DTTTPASMAATLR | 2 | y9 dicharged | 16.5 | 668.33 | 459.25 | 33.8 | 2000 |
| 27 | DTTTPASMAATLR | 2 | y9 monocharged | 16.5 | 668.33 | 917.49 | 33.8 | 2000 |
| 28 | DTTTPASMAGTLR | 3 | y4 monocharged | 15.3 | 441.22 | 446.27 | 20.8 | 2000 |
| 29 | DTTTPASMAGTLR | 2 | y9 dicharged | 15.3 | 661.32 | 452.24 | 33.4 | 2000 |
| 30 | DTTTPASMAGTLR | 2 | y9 monocharged | 15.3 | 661.32 | 903.47 | 33.4 | 2000 |
| 31 | DTTTPASMTATLR | 2 | y9 dicharged | 15.9 | 683.34 | 474.25 | 34.7 | 2000 |
| 32 | DTTTPASMTATLR | 2 | y7 monocharged | 15.9 | 683.34 | 779.41 | 34.7 | 2000 |
| 33 | DTTTPASMTATLR | 2 | y9 monocharged | 15.9 | 683.34 | 947.5 | 34.7 | 2000 |
| 34 | FPMISTFK | 2 | y7 dicharged | 20.2 | 485.76 | 412.22 | 23.4 | 2000 |
| 35 | FPMISTFK | 2 | y5 monocharged | 20.2 | 485.76 | 595.35 | 23.4 | 2000 |
| 36 | FPMISTFK | 2 | y6 monocharged | 20.2 | 485.76 | 726.39 | 23.4 | 2000 |
| 37 | FPMMSTFK | 2 | y7 dicharged | 19.3 | 494.74 | 421.2 | 23.9 | 2000 |
| 38 | FPMMSTFK | 2 | y5 monocharged | 19.3 | 494.74 | 613.3 | 23.9 | 2000 |
| 39 | FPMMSTFK | 2 | y6 monocharged | 19.3 | 494.74 | 744.34 | 23.9 | 2000 |
| 40 | GIVALLGGNIK | 2 | y5 monocharged | 21.1 | 527.84 | 488.28 | 25.8 | 2000 |
| 41 | GIVALLGGNIK | 2 | y6 monocharged | 21.1 | 527.84 | 601.37 | 25.8 | 2000 |
| 42 | GIVALLGGNIK | 2 | y8 monocharged | 21.1 | 527.84 | 785.49 | 25.8 | 2000 |
| 43 | GIVALLGPDNK | 2 | y5 monocharged | 18.9 | 548.82 | 530.26 | 27 | 2000 |
| 44 | GIVALLGPDNK | 2 | y6 monocharged | 19 | 548.82 | 643.34 | 27 | 2000 |
| 45 | GIVALLGPDNK | 2 | y8 monocharged | 18.9 | 548.82 | 827.46 | 27 | 2000 |
| 46 | GIVALLGPNHK | 3 | y9 dicharged | 17.6 | 373.56 | 474.79 | 18.7 | 2000 |
| 47 | GIVALLGPNHK | 3 | y5 monocharged | 17.6 | 373.56 | 552.29 | 18.7 | 2000 |
| 48 | GIVALLGPNHK | 3 | y6 monocharged | 17.6 | 373.56 | 665.37 | 18.7 | 2000 |
| 49 | GIVALLGPNNK | 2 | y5 monocharged | 18.6 | 548.33 | 529.27 | 27 | 2000 |
| 50 | GIVALLGPNNK | 2 | y6 monocharged | 18.6 | 548.33 | 642.36 | 27 | 2000 |
| 51 | GIVALLGPNNK | 2 | y7 monocharged | 18.6 | 548.33 | 755.44 | 27 | 2000 |
| 52 | GIVALLGPNNNAER | 3 | y8 dicharged | 18.8 | 479.93 | 436.2 | 22 | 2000 |
| 53 | GIVALLGPNNNAER | 2 | y7 monocharged | 18.8 | 719.39 | 814.38 | 36.7 | 2000 |
| 54 | GIVALLGPNNNAER | 2 | y8 monocharged | 18.7 | 719.39 | 871.4 | 36.7 | 2000 |
| 55 | GIVALR | 2 | y4 dicharged | 14.1 | 314.71 | 229.66 | 13.7 | 2000 |
| 56 | GIVALR | 2 | y3 monocharged | 14.1 | 314.71 | 359.24 | 13.7 | 2000 |
| 57 | GIVALR | 2 | y4 monocharged | 14.1 | 314.71 | 458.31 | 13.7 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 58 | GPNNK | 2 | y4 dicharged | 0.8 | 265.14 | 236.63 | 10.8 | 2000 |
| 59 | GPNNK | 2 | y3 monocharged | 0.8 | 265.14 | 375.2 | 10.8 | 2000 |
| 60 | GPNNK | 2 | y4 monocharged | 0.8 | 265.14 | 472.25 | 10.8 | 2000 |
| 61 | GTTTPASMAATLR | 2 | y9 dicharged | 16 | 639.33 | 459.25 | 32.2 | 2000 |
| 62 | GTTTPASMAATLR | 2 | y7 monocharged | 16 | 639.33 | 749.4 | 32.2 | 2000 |
| 63 | GTTTPASMAATLR | 2 | y9 monocharged | 16 | 639.33 | 917.49 | 32.2 | 2000 |
| 64 | HLADGMTVGELCAAAITMSDNSAAK | 3 | y6 monocharged | 21.3 | 845.39 | 605.29 | 33.3 | 2000 |
| 65 | HLADGMTVGELCAAAITMSDNSAAK | 3 | y7 monocharged | 21.3 | 845.39 | 692.32 | 33.3 | 2000 |
| 66 | HLADGMTVGELCAAAITMSDNSAAK | 3 | y9 monocharged | 21.3 | 845.39 | 924.41 | 33.3 | 2000 |
| 67 | HLLQWMVDDR | 3 | y3 monocharged | 19.6 | 438.22 | 405.17 | 20.7 | 2000 |
| 68 | HLLQWMVDDR | 3 | y4 monocharged | 19.6 | 438.22 | 504.24 | 20.7 | 2000 |
| 69 | HLLQWMVDDR | 3 | y5 monocharged | 19.6 | 438.22 | 635.28 | 20.7 | 2000 |
| 70 | IHYLQQDLVDYSPVSEK | 3 | y6 monocharged | 19 | 678.68 | 646.34 | 28.1 | 2000 |
| 71 | IHYLQQDLVDYSPVSEK | 3 | y7 monocharged | 19 | 678.68 | 809.4 | 28.1 | 2000 |
| 72 | IHYLQQDLVDYSPVSEK | 3 | y8 monocharged | 18.9 | 678.68 | 924.43 | 28.1 | 2000 |
| 73 | IVVIYLR | 2 | y3 monocharged | 19.3 | 438.29 | 451.27 | 20.7 | 2000 |
| 74 | IVVIYLR | 2 | y4 monocharged | 19.3 | 438.29 | 564.35 | 20.7 | 2000 |
| 75 | IVVIYLR | 2 | y5 monocharged | 19.3 | 438.29 | 663.42 | 20.7 | 2000 |
| 76 | LCIISLLAALPLAVHASPQPLEQIK | 3 | y17 dicharged | 30.7 | 899.19 | 906.52 | 35 | 2000 |
| 77 | LCIISLLAALPLAVHASPQPLEQIK | 3 | y18 dicharged | 30.7 | 899.19 | 942.04 | 35 | 2000 |
| 78 | LCIISLLAALPLAVHASPQPLEQIK | 3 | y22 dicharged | 30.7 | 899.19 | 1155.18 | 35 | 2000 |
| 79 | LCIISLLATLPLAVHASPQPLDQIK | 3 | y19 dicharged | 30.2 | 904.52 | 1006.58 | 35.1 | 2000 |
| 80 | LCIISLLATLPLAVHASPQPLDQIK | 3 | y22 dicharged | 30.2 | 904.52 | 1163.18 | 35.1 | 2000 |
| 81 | LCIISLLATLPLAVHASPQPLDQIK | 3 | y23 dicharged | 30.3 | 904.52 | 1219.72 | 35.1 | 2000 |
| 82 | LCIISLLATLPLAVHASPQPLEQIK | 3 | y15 dicharged | 30.2 | 909.19 | 814.46 | 35.3 | 2000 |
| 83 | LCIISLLATLPLAVHASPQPLEQIK | 3 | y17 dicharged | 30.2 | 909.19 | 921.53 | 35.3 | 2000 |
| 84 | LCIISLLATLPLAVHASPQPLEQIK | 3 | y19 dicharged | 30.2 | 909.19 | 1013.59 | 35.3 | 2000 |
| 85 | LCIISLLATLPLAVHSSPQPLEQIK | 3 | y15 dicharged | 29.3 | 914.53 | 822.46 | 35.4 | 2000 |
| 86 | LCIISLLATLPLAVHSSPQPLEQIK | 3 | y18 dicharged | 29.3 | 914.53 | 965.04 | 35.4 | 2000 |
| 87 | LCIISLLATLPLAVHSSPQPLEQIK | 3 | y21 dicharged | 29.3 | 914.53 | 1121.64 | 35.4 | 2000 |
| 88 | LCIISLLATLPLAVHTSPQPLEQIK | 3 | y15 dicharged | 29.4 | 919.2 | 829.47 | 35.6 | 2000 |
| 89 | LCIISLLATLPLAVHTSPQPLEQIK | 3 | y21 dicharged | 29.5 | 919.2 | 1128.65 | 35.6 | 2000 |
| 90 | LCIISLLATLPLAVHTSPQPLEQIK | 3 | y23 dicharged | 29.4 | 919.2 | 1241.74 | 35.6 | 2000 |
| 91 | LCIISLLATLPLTVHASPQPLEQIK | 3 | y15 dicharged | 29.8 | 919.2 | 829.47 | 35.6 | 2000 |
| 92 | LCIISLLATLPLTVHASPQPLEQIK | 3 | y17 dicharged | 29.8 | 919.2 | 936.53 | 35.6 | 2000 |
| 93 | LCIISLLATLPLTVHASPQPLEQIK | 3 | y22 dicharged | 29.8 | 919.2 | 1185.19 | 35.6 | 2000 |
| 94 | LCIISLLATLPLVVHASPQPLEQIK | 3 | y19 dicharged | 31.3 | 918.54 | 1027.6 | 35.6 | 2000 |
| 95 | LCIISLLATLPLVVHASPQPLEQIK | 3 | y21 dicharged | 31.3 | 918.54 | 1127.66 | 35.6 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 96 | LCIISLLATLPLVVHASPQPLEQIK | 3 | y23 dicharged | 31.3 | 918.54 | 1240.75 | 35.6 | 2000 |
| 97 | LCIISLLATLSLAVHASPQPLEQIK | 3 | y18 dicharged | 31.2 | 905.85 | 952.04 | 35.2 | 2000 |
| 98 | LCIISLLATLSLAVHASPQPLEQIK | 3 | y22 dicharged | 31.3 | 905.85 | 1165.18 | 35.2 | 2000 |
| 99 | LCIISLLATLSLAVHASPQPLEQIK | 3 | y23 dicharged | 31.2 | 905.85 | 1221.72 | 35.2 | 2000 |
| 100 | LCIISLLATMPLAVHASPQPLEQIK | 3 | y18 dicharged | 28.9 | 915.18 | 966.03 | 35.5 | 2000 |
| 101 | LCIISLLATMPLAVHASPQPLEQIK | 3 | y19 dicharged | 28.9 | 915.18 | 1022.57 | 35.5 | 2000 |
| 102 | LCIISLLATMPLAVHASPQPLEQIK | 3 | y23 dicharged | 28.9 | 915.18 | 1235.71 | 35.5 | 2000 |
| 103 | LCIISLLAVLPLAVHASPQPLEQIK | 3 | y17 dicharged | 31 | 908.54 | 920.54 | 35.2 | 2000 |
| 104 | LCIISLLAVLPLAVHASPQPLEQIK | 3 | y22 dicharged | 31.1 | 908.54 | 1169.2 | 35.2 | 2000 |
| 105 | LCIISLLAVLPLAVHASPQPLEQIK | 3 | y23 dicharged | 31.1 | 908.54 | 1225.74 | 35.2 | 2000 |
| 106 | LLISQR | 2 | y3 monocharged | 13.4 | 365.24 | 390.21 | 16.6 | 2000 |
| 107 | LLISQR | 2 | y4 monocharged | 13.4 | 365.24 | 503.29 | 16.6 | 2000 |
| 108 | LLISQR | 2 | y5 monocharged | 13.4 | 365.24 | 616.38 | 16.6 | 2000 |
| 109 | LLLATVGGPAGLTAFLR | 3 | y4 monocharged | 26.9 | 557.34 | 506.31 | 24.4 | 2000 |
| 110 | LLLATVGGPAGLTAFLR | 3 | y5 monocharged | 26.9 | 557.34 | 607.36 | 24.4 | 2000 |
| 111 | LLLATVGGPAGLTAFLR | 2 | y11 monocharged | 26.9 | 835.5 | 1059.6 | 43.4 | 2000 |
| 112 | LLNSQR | 2 | y3 monocharged | 8.4 | 365.71 | 390.21 | 16.6 | 2000 |
| 113 | LLNSQR | 2 | y4 monocharged | 8.4 | 365.71 | 504.25 | 16.6 | 2000 |
| 114 | LLNSQR | 2 | y5 monocharged | 8.4 | 365.71 | 617.34 | 16.6 | 2000 |
| 115 | LLTNQR | 2 | y3 monocharged | 9.3 | 372.72 | 417.22 | 17 | 2000 |
| 116 | LLTNQR | 2 | y4 monocharged | 9.3 | 372.72 | 518.27 | 17 | 2000 |
| 117 | LLTNQR | 2 | y5 monocharged | 9.3 | 372.72 | 631.35 | 17 | 2000 |
| 118 | LLTSQR | 2 | y3 monocharged | 9.5 | 359.22 | 390.21 | 16.2 | 2000 |
| 119 | LLTSQR | 2 | y4 monocharged | 9.5 | 359.22 | 491.26 | 16.2 | 2000 |
| 120 | LLTSQR | 2 | y5 monocharged | 9.5 | 359.22 | 604.34 | 16.2 | 2000 |
| 121 | LNIISLLATLPLAVHASPQPLEQIK | 3 | y17 dicharged | 30.8 | 893.87 | 921.53 | 34.8 | 2000 |
| 122 | LNIISLLATLPLAVHASPQPLEQIK | 3 | y18 dicharged | 30.7 | 893.87 | 957.05 | 34.8 | 2000 |
| 123 | LNIISLLATLPLAVHASPQPLEQIK | 3 | y21 dicharged | 30.8 | 893.87 | 1113.65 | 34.8 | 2000 |
| 124 | LSASSQR | 2 | y4 monocharged | 1.2 | 374.7 | 477.24 | 17.1 | 2000 |
| 125 | LSASSQR | 2 | y5 monocharged | 1.2 | 374.7 | 548.28 | 17.1 | 2000 |
| 126 | LSASSQR | 2 | y6 monocharged | 1.2 | 374.7 | 635.31 | 17.1 | 2000 |
| 127 | LSESQLSGR | 2 | y8 dicharged | 11.6 | 488.76 | 432.22 | 23.6 | 2000 |
| 128 | LSESQLSGR | 2 | y6 monocharged | 11.6 | 488.76 | 647.35 | 23.6 | 2000 |
| 129 | LSESQLSGR | 2 | y7 monocharged | 11.6 | 488.76 | 776.39 | 23.6 | 2000 |
| 130 | LSESQLSGSVGMIEMDLASGR | 3 | y3 monocharged | 23.7 | 723.02 | 319.17 | 29.5 | 2000 |
| 131 | LSESQLSGSVGMIEMDLASGR | 3 | y4 monocharged | 23.7 | 723.02 | 390.21 | 29.5 | 2000 |
| 132 | LSESQLSGSVGMIEMDLASGR | 3 | y6 monocharged | 23.7 | 723.02 | 618.32 | 29.5 | 3000 |
| 133 | MVVIYLR | 2 | y3 monocharged | 19.5 | 447.27 | 451.27 | 21.2 | 3000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 134 | MVVIYLR | 2 | y4 monocharged | 19.5 | 447.27 | 564.35 | 21.2 | 3000 |
| 135 | MVVIYLR | 2 | y5 monocharged | 19.5 | 447.27 | 663.42 | 21.2 | 2000 |
| 136 | NEALPGDAR | 2 | y5 monocharged | 10.9 | 471.74 | 515.26 | 22.6 | 2000 |
| 137 | NEALPGDAR | 2 | y6 monocharged | 10.9 | 471.74 | 628.34 | 22.6 | 2000 |
| 138 | NEALPGDAR | 2 | y7 monocharged | 10.9 | 471.74 | 699.38 | 22.6 | 2000 |
| 139 | NQHIAGIGAALIEHWQR | 3 | y13 dicharged | 20.1 | 638.68 | 711.39 | 26.9 | 2000 |
| 140 | NQHIAGIGAALIEHWQR | 3 | y14 dicharged | 20.1 | 638.68 | 767.93 | 26.9 | 2000 |
| 141 | NQHIAGIGAALIEHWQR | 3 | y15 dicharged | 20.1 | 638.68 | 836.46 | 26.9 | 2000 |
| 142 | NQQIAGIGAALIEHWQR | 3 | y13 dicharged | 22.3 | 635.67 | 711.39 | 26.8 | 2000 |
| 143 | NQQIAGIGAALIEHWQR | 3 | y14 dicharged | 22.3 | 635.67 | 767.93 | 26.8 | 2000 |
| 144 | NQQIAGIGAALIEHWQR | 3 | y15 dicharged | 22.3 | 635.67 | 831.96 | 26.8 | 2000 |
| 145 | NQQIAGLGAALIEHWQR | 3 | y13 dicharged | 22.7 | 635.67 | 711.39 | 26.8 | 2000 |
| 146 | NQQIAGLGAALIEHWQR | 3 | y14 dicharged | 22.7 | 635.67 | 767.93 | 26.8 | 2000 |
| 147 | NQQIAGLGAALIEHWQR | 3 | y15 dicharged | 22.6 | 635.67 | 831.96 | 26.8 | 2000 |
| 148 | NTTTPASMAATLR | 3 | y4 monocharged | 16 | 445.56 | 460.29 | 20.9 | 2000 |
| 149 | NTTTPASMAATLR | 3 | y5 monocharged | 16 | 445.56 | 531.33 | 20.9 | 2000 |
| 150 | NTTTPASMAATLR | 2 | y9 monocharged | 16 | 667.84 | 917.49 | 33.8 | 2000 |
| 151 | NVLTSQR | 2 | y3 monocharged | 10.2 | 409.23 | 390.21 | 19.1 | 2000 |
| 152 | NVLTSQR | 2 | y4 monocharged | 10.2 | 409.23 | 491.26 | 19.1 | 2000 |
| 153 | NVLTSQR | 2 | y5 monocharged | 10.2 | 409.23 | 604.34 | 19.1 | 2000 |
| 154 | QIDDNVTR | 2 | y4 monocharged | 10 | 480.74 | 489.28 | 23.1 | 2000 |
| 155 | QIDDNVTR | 2 | y5 monocharged | 10 | 480.74 | 604.31 | 23.1 | 2000 |
| 156 | QIDDNVTR | 2 | y6 monocharged | 10 | 480.74 | 719.33 | 23.1 | 2000 |
| 157 | QIGDK | 3 | y4 monocharged | 1.1 | 187.44 | 432.25 | 12.9 | 2000 |
| 158 | QIGDK | 2 | y3 monocharged | 1.1 | 280.66 | 319.16 | 11.7 | 2000 |
| 159 | QIGDK | 2 | y4 monocharged | 1.1 | 280.66 | 432.25 | 11.7 | 2000 |
| 160 | QIGDNVTR | 2 | y3 monocharged | 10.2 | 451.74 | 375.24 | 21.5 | 2000 |
| 161 | QIGDNVTR | 2 | y4 monocharged | 10.2 | 451.74 | 489.28 | 21.5 | 2000 |
| 162 | QIGDNVTR | 2 | y6 monocharged | 10.2 | 451.74 | 661.33 | 21.5 | 2000 |
| 163 | QIGENVTR | 2 | y3 monocharged | 10.3 | 458.75 | 375.24 | 21.9 | 2000 |
| 164 | QIGENVTR | 2 | y4 monocharged | 10.3 | 458.75 | 489.28 | 21.9 | 2000 |
| 165 | QIGENVTR | 2 | y6 monocharged | 10.3 | 458.75 | 675.34 | 21.9 | 2000 |
| 166 | QLLQWMVDAR | 2 | y5 monocharged | 22.1 | 630.33 | 591.29 | 31.7 | 2000 |
| 167 | QLLQWMVDAR | 2 | y6 monocharged | 22.1 | 630.33 | 777.37 | 31.7 | 2000 |
| 168 | QLLQWMVDAR | 2 | y7 monocharged | 22.1 | 630.33 | 905.43 | 31.7 | 2000 |
| 169 | QLLQWMVDDGVAGPLIR | 3 | y4 monocharged | 25.7 | 637.68 | 498.34 | 26.8 | 2000 |
| 170 | QLLQWMVDDGVAGPLIR | 3 | y5 monocharged | 25.8 | 637.68 | 555.36 | 26.8 | 2000 |
| 171 | QLLQWMVDDGVAGPLIR | 3 | y6 monocharged | 25.7 | 637.68 | 626.4 | 26.8 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 172 | QLLQWMVDDR | 2 | y4 monocharged | 21.7 | 652.33 | 504.24 | 32.9 | 2000 |
| 173 | QLLQWMVDDR | 2 | y5 monocharged | 21.7 | 652.33 | 635.28 | 32.9 | 2000 |
| 174 | QLLQWMVDDR | 2 | y6 monocharged | 21.7 | 652.33 | 821.36 | 32.9 | 2000 |
| 175 | QLLQWMVDGR | 2 | y4 monocharged | 21.4 | 623.32 | 446.24 | 31.3 | 2000 |
| 176 | QLLQWMVDGR | 2 | y5 monocharged | 21.4 | 623.32 | 577.28 | 31.3 | 2000 |
| 177 | QLLQWMVDGR | 2 | y6 monocharged | 21.4 | 623.32 | 763.36 | 31.3 | 2000 |
| 178 | QLLQWMVEDR | 3 | y4 monocharged | 21.7 | 439.89 | 518.26 | 20.7 | 2000 |
| 179 | QLLQWMVEDR | 2 | y5 monocharged | 21.7 | 659.34 | 649.3 | 33.3 | 2000 |
| 180 | QLLQWMVEDR | 2 | y6 monocharged | 21.7 | 659.34 | 835.38 | 33.3 | 2000 |
| 181 | QQDLVDYSPVSEK | 3 | y5 monocharged | 16 | 503.25 | 559.31 | 22.7 | 2000 |
| 182 | QQDLVDYSPVSEK | 2 | y5 monocharged | 16 | 754.37 | 559.31 | 38.7 | 2000 |
| 183 | QQDLVDYSPVSEK | 2 | y8 monocharged | 16 | 754.37 | 924.43 | 38.7 | 2000 |
| 184 | QQHLVDYSPVSEK | 3 | y6 dicharged | 14.2 | 510.59 | 323.67 | 22.9 | 2000 |
| 185 | QQHLVDYSPVSEK | 3 | y5 monocharged | 14.2 | 510.59 | 559.31 | 22.9 | 2000 |
| 186 | QQHLVDYSPVSEK | 3 | y6 monocharged | 14.3 | 510.59 | 646.34 | 22.9 | 2000 |
| 187 | QSESQLSGR | 2 | y3 monocharged | 7.2 | 496.24 | 319.17 | 24 | 2000 |
| 188 | QSESQLSGR | 2 | y8 dicharged | 7.2 | 496.24 | 432.22 | 24 | 2000 |
| 189 | QSESQLSGR | 2 | y4 monocharged | 7.2 | 496.24 | 432.26 | 24 | 2000 |
| 190 | QSESQLSGSVGMIEMDLASGR | 3 | y3 monocharged | 22.3 | 728.01 | 319.17 | 29.7 | 2000 |
| 191 | QSESQLSGSVGMIEMDLASGR | 3 | y6 monocharged | 22.3 | 728.01 | 618.32 | 29.7 | 2000 |
| 192 | QSESQLSGSVGMIEMDLASGR | 3 | y8 monocharged | 22.3 | 728.01 | 878.4 | 29.7 | 2000 |
| 193 | SQLQLLQWMVDDR | 3 | y4 monocharged | 24.9 | 544.61 | 504.24 | 24 | 2000 |
| 194 | SQLQLLQWMVDDR | 3 | y5 monocharged | 24.9 | 544.61 | 635.28 | 24 | 2000 |
| 195 | SQLQLLQWMVDDR | 3 | y6 monocharged | 24.9 | 544.61 | 821.36 | 24 | 2000 |
| 196 | SVLPAGWFIADK | 2 | y9 dicharged | 23.1 | 652.36 | 502.76 | 32.9 | 2000 |
| 197 | SVLPAGWFIADK | 2 | y10 dicharged | 23.1 | 652.36 | 559.31 | 32.9 | 2000 |
| 198 | SVLPAGWFIADK | 2 | y9 monocharged | 23.1 | 652.36 | 1004.52 | 32.9 | 2000 |
| 199 | SVLPAGWFIADR | 2 | y9 dicharged | 23.4 | 666.36 | 516.77 | 33.7 | 2000 |
| 200 | SVLPAGWFIADR | 2 | y10 dicharged | 23.4 | 666.36 | 573.31 | 33.7 | 2000 |
| 201 | SVLPAGWFIADR | 2 | y9 monocharged | 23.4 | 666.36 | 1032.53 | 33.7 | 2000 |
| 202 | SVLSAGWFIADK | 2 | y7 monocharged | 22.3 | 647.35 | 836.43 | 32.6 | 2000 |
| 203 | SVLSAGWFIADK | 2 | y8 monocharged | 22.3 | 647.35 | 907.47 | 32.6 | 2000 |
| 204 | SVLSAGWFIADK | 2 | y9 monocharged | 22.3 | 647.35 | 994.5 | 32.6 | 2000 |
| 205 | TGAAER | 2 | y3 monocharged | 1 | 302.66 | 375.2 | 13 | 2000 |
| 206 | TGAAER | 2 | y4 monocharged | 1 | 302.66 | 446.24 | 13 | 2000 |
| 207 | TGAAER | 2 | y5 monocharged | 1 | 302.66 | 503.26 | 13 | 2000 |
| 208 | TGAAK | 2 | y4 dicharged | 0.8 | 224.13 | 173.61 | 8.5 | 2000 |
| 209 | TGAAK | 2 | y3 monocharged | 0.8 | 224.13 | 289.19 | 8.5 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 210 | TGAAK | 2 | y4 monocharged | 0.8 | 224.13 | 346.21 | 8.5 | 2000 |
| 211 | TGAGER | 2 | y3 monocharged | 1 | 295.65 | 361.18 | 12.6 | 2000 |
| 212 | TGAGER | 2 | y4 monocharged | 1 | 295.65 | 432.22 | 12.6 | 2000 |
| 213 | TGAGER | 2 | y5 monocharged | 1 | 295.65 | 489.24 | 12.6 | 2000 |
| 214 | TGAGK | 3 | y4 monocharged | 0.7 | 145.09 | 332.19 | 11.6 | 2000 |
| 215 | TGAGK | 2 | y3 monocharged | 0.7 | 217.12 | 275.17 | 8.1 | 2000 |
| 216 | TGAGK | 2 | y4 monocharged | 0.7 | 217.12 | 332.19 | 8.1 | 2000 |
| 217 | TGASER | 2 | y3 monocharged | 1 | 310.65 | 391.19 | 13.4 | 2000 |
| 218 | TGASER | 2 | y4 monocharged | 1 | 310.65 | 462.23 | 13.4 | 2000 |
| 219 | TGASER | 2 | y5 monocharged | 1 | 310.65 | 519.25 | 13.4 | 2000 |
| 220 | TGASK | 2 | y4 dicharged | 0.8 | 232.13 | 181.61 | 9 | 2000 |
| 221 | TGASK | 2 | y3 monocharged | 0.8 | 232.13 | 305.18 | 9 | 2000 |
| 222 | TGASK | 2 | y4 monocharged | 0.8 | 232.13 | 362.2 | 9 | 2000 |
| 223 | TGASR | 3 | y4 monocharged | 0.8 | 164.42 | 390.21 | 12.2 | 2000 |
| 224 | TGASR | 2 | y3 monocharged | 0.8 | 246.13 | 333.19 | 9.8 | 2000 |
| 225 | TGASR | 2 | y4 monocharged | 0.8 | 246.13 | 390.21 | 9.8 | 2000 |
| 226 | TLTAWCADER | 2 | y5 monocharged | 15.5 | 611.78 | 650.26 | 30.6 | 5200 |
| 227 | TLTAWCADER | 2 | y6 monocharged | 15.5 | 611.78 | 836.34 | 30.6 | 5200 |
| 228 | TLTAWCADER | 2 | y8 monocharged | 15.5 | 611.78 | 1008.42 | 30.6 | 5200 |
| 229 | TLTAWHADER | 3 | y6 dicharged | 13.1 | 400.53 | 407.19 | 19.5 | 2000 |
| 230 | TLTAWHADER | 3 | y8 dicharged | 13.1 | 400.53 | 493.23 | 19.5 | 2000 |
| 231 | TLTAWHADER | 3 | y5 monocharged | 13.1 | 400.53 | 627.28 | 19.5 | 2000 |
| 232 | TLTAWR | 2 | y3 monocharged | 14.6 | 374.21 | 432.24 | 17.1 | 2000 |
| 233 | TLTAWR | 2 | y4 monocharged | 14.6 | 374.21 | 533.28 | 17.1 | 2000 |
| 234 | TLTAWR | 2 | y5 monocharged | 14.6 | 374.21 | 646.37 | 17.1 | 2000 |
| 235 | TVGGPAGLTAFLR | 2 | y5 monocharged | 22 | 630.36 | 607.36 | 31.7 | 2000 |
| 236 | TVGGPAGLTAFLR | 2 | y7 monocharged | 22 | 630.36 | 777.46 | 31.7 | 2000 |
| 237 | TVGGPAGLTAFLR | 2 | y11 monocharged | 22 | 630.36 | 1059.6 | 31.7 | 2000 |
| 238 | TVVIYLR | 2 | y3 monocharged | 17.5 | 432.27 | 451.27 | 20.4 | 2000 |
| 239 | TVVIYLR | 2 | y4 monocharged | 17.5 | 432.27 | 564.35 | 20.4 | 2000 |
| 240 | TVVIYLR | 2 | y5 monocharged | 17.4 | 432.27 | 663.42 | 20.4 | 2000 |
| 241 | VAGPLIR | 2 | y4 monocharged | 13.8 | 363.24 | 498.34 | 16.4 | 2000 |
| 242 | VAGPLIR | 2 | y5 monocharged | 13.8 | 363.24 | 555.36 | 16.4 | 2000 |
| 243 | VAGPLIR | 2 | y6 monocharged | 13.8 | 363.24 | 626.4 | 16.4 | 2000 |
| 244 | VALCGAVLAR | 2 | y8 dicharged | 16.4 | 515.3 | 430.25 | 25.1 | 2000 |
| 245 | VALCGAVLAR | 2 | y6 monocharged | 16.4 | 515.3 | 586.37 | 25.1 | 2000 |
| 246 | VALCGAVLAR | 2 | y7 monocharged | 16.4 | 515.3 | 746.4 | 25.1 | 2000 |
| 247 | VDAGDEQLER | 2 | y5 monocharged | 11 | 566.27 | 674.35 | 28 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 248 | VDAGDEQLER | 2 | y7 monocharged | 11 | 566.27 | 846.4 | 28 | 2000 |
| 249 | VDAGDEQLER | 2 | y8 monocharged | 11 | 566.27 | 917.43 | 28 | 2000 |
| 250 | VDAGDK | 2 | y3 monocharged | 1 | 302.65 | 319.16 | 13 | 2000 |
| 251 | VDAGDK | 2 | y4 monocharged | 1 | 302.65 | 390.2 | 13 | 2000 |
| 252 | VDAGDK | 2 | y5 monocharged | 1 | 302.65 | 505.23 | 13 | 2000 |
| 253 | VGMIEMDLASGR | 2 | y6 monocharged | 19.3 | 639.81 | 618.32 | 32.2 | 2000 |
| 254 | VGMIEMDLASGR | 2 | y7 monocharged | 19.3 | 639.81 | 749.36 | 32.2 | 2000 |
| 255 | VGMIEMDLASGR | 2 | y8 monocharged | 19.3 | 639.81 | 878.4 | 32.2 | 2000 |
| 256 | VGMIEMDLASR | 2 | y6 monocharged | 19.2 | 611.3 | 692.34 | 30.6 | 2000 |
| 257 | VGMIEMDLASR | 2 | y7 monocharged | 19.2 | 611.3 | 821.38 | 30.6 | 2000 |
| 258 | VGMIEMDLASR | 2 | y8 monocharged | 19.2 | 611.3 | 934.47 | 30.6 | 2000 |
| 259 | VGMIEMDLASSR | 2 | y6 monocharged | 18.8 | 654.82 | 648.33 | 33.1 | 2000 |
| 260 | VGMIEMDLASSR | 2 | y7 monocharged | 18.8 | 654.82 | 779.37 | 33.1 | 2000 |
| 261 | VGMIEMDLASSR | 2 | y8 monocharged | 18.8 | 654.82 | 908.41 | 33.1 | 2000 |
| 262 | VLLCGAVLAR | 2 | y6 monocharged | 18.2 | 536.32 | 586.37 | 26.3 | 5400 |
| 263 | VLLCGAVLAR | 2 | y7 monocharged | 18.3 | 536.32 | 746.4 | 26.3 | 5400 |
| 264 | VLLCGAVLAR | 2 | y8 monocharged | 18.3 | 536.32 | 859.48 | 26.3 | 5400 |
| 265 | VVLCGAMLAR | 2 | y6 monocharged | 17.7 | 545.3 | 618.34 | 26.8 | 2000 |
| 266 | VVLCGAMLAR | 2 | y7 monocharged | 17.7 | 545.3 | 778.37 | 26.8 | 2000 |
| 267 | VVLCGAMLAR | 2 | y8 monocharged | 17.7 | 545.3 | 891.45 | 26.8 | 2000 |
| 268 | VVLCGAVLAR | 2 | y6 monocharged | 17.2 | 529.31 | 586.37 | 25.9 | 2000 |
| 269 | VVLCGAVLAR | 2 | y7 monocharged | 17.2 | 529.31 | 746.4 | 25.9 | 2000 |
| 270 | VVLCGAVLAR | 2 | y8 monocharged | 17.2 | 529.31 | 859.48 | 25.9 | 2000 |
| 271 | VVLCGTVLAR | 2 | y6 monocharged | 16.9 | 544.32 | 616.38 | 26.8 | 2000 |
| 272 | VVLCGTVLAR | 2 | y7 monocharged | 16.9 | 544.32 | 776.41 | 26.8 | 2000 |
| 273 | VVLCGTVLAR | 2 | y8 monocharged | 16.9 | 544.32 | 889.49 | 26.8 | 2000 |
| 274 | WETDR | 3 | y4 monocharged | 8.2 | 236.11 | 520.24 | 14.4 | 2000 |
| 275 | WETDR | 2 | y3 monocharged | 8.2 | 353.66 | 391.19 | 15.9 | 2000 |
| 276 | WETDR | 2 | y4 monocharged | 8.2 | 353.66 | 520.24 | 15.9 | 2000 |
| 277 | WETELNEAFPGDAR | 3 | y5 monocharged | 19.1 | 545.59 | 515.26 | 24 | 2000 |
| 278 | WETELNEAFPGDAR | 3 | y6 monocharged | 19.1 | 545.59 | 662.33 | 24 | 2000 |
| 279 | WETELNEAFPGDAR | 2 | y5 monocharged | 19.1 | 817.88 | 515.26 | 42.4 | 2000 |
| 280 | WETELNEALPADAR | 3 | y5 monocharged | 18.5 | 538.93 | 529.27 | 23.8 | 2000 |
| 281 | WETELNEALPADAR | 2 | y5 monocharged | 18.5 | 807.89 | 529.27 | 41.8 | 2000 |
| 282 | WETELNEALPADAR | 2 | y7 monocharged | 18.5 | 807.89 | 713.39 | 41.8 | 2000 |
| 283 | WETELNEALPGDAR | 3 | y5 monocharged | 18.2 | 534.26 | 515.26 | 23.6 | 2000 |
| 284 | WETELNEALPGDAR | 2 | y5 monocharged | 18.2 | 800.88 | 515.26 | 41.4 | 2000 |
| 285 | WETELNEALPGDAR | 2 | y7 monocharged | 18.2 | 800.88 | 699.38 | 41.4 | 2000 |

TABLE 47-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 286 | WETELNEALSGDAR | 3 | y5 monocharged | 18.9 | 530.92 | 505.24 | 23.5 | 2000 |
| 287 | WETELNEALSGDAR | 3 | y6 monocharged | 18.9 | 530.92 | 618.32 | 23.5 | 2000 |
| 288 | WETELNEALSGDAR | 2 | y5 monocharged | 18.9 | 795.87 | 505.24 | 41.1 | 2000 |
| 289 | WETELNEVLPGDAR | 3 | y5 monocharged | 20.1 | 543.6 | 515.26 | 23.9 | 2000 |
| 290 | WETELNEVLPGDAR | 2 | y5 monocharged | 20.1 | 814.9 | 515.26 | 42.2 | 2000 |
| 291 | WETELNEVLPGDAR | 2 | y6 monocharged | 20.1 | 814.9 | 628.34 | 42.2 | 2000 |
| 292 | WETER | 3 | y4 monocharged | 9 | 240.78 | 534.25 | 14.5 | 2000 |
| 293 | WETER | 2 | y3 monocharged | 8.9 | 360.67 | 405.21 | 16.3 | 2000 |
| 294 | WETER | 2 | y4 monocharged | 8.9 | 360.67 | 534.25 | 16.3 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1 sec |
| Detection window: | 120 sec |

The areas obtained for each of the transitions and for each of the microorganisms studied were measured. When the areas of the transitions are greater than or equal to the positivity threshold described in TABLE 47, the detection of the transition is considered to be positive and is labelled "1" in TABLE 48. When a transition has an area less than the positivity threshold described in TABLE 47, the transition is considered non-detected and is labelled "0" in TABLE 48.

For a given peptide, when at least 3 transitions are labelled "1", the peptide is considered as being detected.

TABLE 48

| transition number | Sam131 | Sam132 | Sam133 | Sam134 | Sam135 | Sam136 | Sam137 | Sam138 | Sam139 | Sam140 | Sam141 | Sam142 | Sam143 | Sam144 |
|---|---|---|---|---|---|---|---|---|---|---|---|---|---|---|
| 1 | 0 | 0 | 0 | 0 | 0 | 0 | 0 | 0 | 0 | 0 | 0 | 0 | 0 | 0 |
| 2 | 0 | 0 | 0 | 0 | 0 | 0 | 0 | 0 | 1 | 0 | 0 | 0 | 1 | 0 |
| 3 | 0 | 0 | 0 | 0 | 0 | 0 | 0 | 0 | 0 | 0 | 0 | 0 | 1 | 0 |
| 4 | 0 | 0 | 0 | 0 | 0 | 0 | 0 | 0 | 0 | 0 | 0 | 0 | 0 | 0 |
| 5 | 0 | 0 | 0 | 0 | 0 | 0 | 0 | 0 | 0 | 0 | 0 | 0 | 0 | 0 |
| 6 | 0 | 0 | 0 | 0 | 0 | 0 | 0 | 0 | 0 | 0 | 0 | 0 | 0 | 0 |
| 7 | 0 | 0 | 0 | 0 | 0 | 0 | 0 | 0 | 0 | 0 | 0 | 0 | 0 | 0 |
| 8 | 0 | 0 | 0 | 0 | 0 | 0 | 0 | 0 | 0 | 0 | 0 | 0 | 0 | 0 |
| 9 | 0 | 0 | 0 | 0 | 0 | 0 | 0 | 0 | 0 | 0 | 0 | 0 | 0 | 0 |
| 10 | 0 | 0 | 0 | 0 | 0 | 0 | 0 | 0 | 0 | 0 | 0 | 0 | 0 | 0 |
| 11 | 0 | 0 | 0 | 0 | 1 | 0 | 0 | 0 | 0 | 0 | 0 | 0 | 0 | 0 |
| 12 | 0 | 0 | 0 | 0 | 1 | 0 | 0 | 0 | 0 | 0 | 0 | 0 | 0 | 0 |
| 13 | 0 | 0 | 0 | 0 | 0 | 0 | 0 | 0 | 0 | 0 | 0 | 0 | 0 | 0 |
| 14 | 0 | 0 | 0 | 0 | 0 | 0 | 0 | 1 | 0 | 0 | 0 | 0 | 1 | 0 |
| 15 | 0 | 0 | 0 | 0 | 0 | 0 | 0 | 0 | 0 | 0 | 0 | 0 | 0 | 0 |
| 16 | 0 | 0 | 0 | 0 | 0 | 0 | 0 | 0 | 0 | 0 | 0 | 0 | 0 | 0 |
| 17 | 1 | 0 | 0 | 0 | 0 | 1 | 1 | 1 | 1 | 1 | 1 | 1 | 1 | 1 |
| 18 | 0 | 0 | 0 | 0 | 0 | 0 | 0 | 0 | 0 | 0 | 0 | 0 | 0 | 0 |
| 19 | 1 | 0 | 0 | 0 | 1 | 1 | 1 | 1 | 1 | 0 | 0 | 1 | 1 | 1 |
| 20 | 1 | 0 | 0 | 0 | 1 | 1 | 1 | 0 | 1 | 0 | 0 | 1 | 1 | 1 |
| 21 | 1 | 0 | 1 | 0 | 1 | 1 | 1 | 0 | 1 | 0 | 0 | 1 | 1 | 0 |
| 22 | 0 | 0 | 0 | 0 | 0 | 0 | 0 | 0 | 0 | 0 | 0 | 0 | 0 | 0 |
| 23 | 0 | 0 | 0 | 0 | 0 | 0 | 0 | 0 | 0 | 0 | 0 | 0 | 0 | 0 |
| 24 | 0 | 0 | 0 | 0 | 0 | 0 | 0 | 0 | 0 | 0 | 0 | 0 | 0 | 0 |
| 25 | 1 | 1 | 1 | 0 | 1 | 1 | 1 | 0 | 1 | 0 | 1 | 1 | 1 | 0 |
| 26 | 1 | 1 | 1 | 0 | 1 | 1 | 1 | 0 | 1 | 1 | 1 | 1 | 1 | 0 |

TABLE 48-continued

| transition number | Sam131 | Sam132 | Sam133 | Sam134 | Sam135 | Sam136 | Sam137 | Sam138 | Sam139 | Sam140 | Sam141 | Sam142 | Sam143 | Sam144 |
|---|---|---|---|---|---|---|---|---|---|---|---|---|---|---|
| 27 | 0 | 1 | 1 | 0 | 1 | 1 | 1 | 0 | 1 | 0 | 1 | 1 | 1 | 0 |
| 28 | 0 | 0 | 0 | 0 | 0 | 0 | 0 | 0 | 0 | 0 | 0 | 0 | 0 | 0 |
| 29 | 0 | 0 | 0 | 0 | 0 | 0 | 0 | 0 | 0 | 0 | 0 | 0 | 0 | 0 |
| 30 | 0 | 0 | 0 | 0 | 0 | 0 | 0 | 0 | 0 | 0 | 0 | 0 | 0 | 0 |
| 31 | 0 | 0 | 0 | 0 | 0 | 1 | 0 | 0 | 0 | 0 | 0 | 0 | 0 | 0 |
| 32 | 0 | 0 | 0 | 0 | 0 | 0 | 0 | 0 | 0 | 0 | 0 | 0 | 0 | 0 |
| 33 | 0 | 0 | 0 | 0 | 0 | 0 | 0 | 0 | 0 | 0 | 0 | 0 | 0 | 0 |
| 34 | 0 | 0 | 0 | 0 | 0 | 0 | 0 | 0 | 0 | 0 | 0 | 0 | 0 | 0 |
| 35 | 0 | 0 | 0 | 0 | 0 | 0 | 0 | 0 | 0 | 0 | 0 | 0 | 0 | 0 |
| 36 | 0 | 0 | 0 | 0 | 0 | 0 | 0 | 0 | 0 | 0 | 0 | 0 | 0 | 0 |
| 37 | 0 | 0 | 0 | 0 | 0 | 0 | 0 | 0 | 0 | 0 | 0 | 0 | 0 | 0 |
| 38 | 0 | 0 | 0 | 0 | 1 | 0 | 0 | 1 | 0 | 0 | 0 | 0 | 1 | 0 |
| 39 | 0 | 0 | 0 | 0 | 0 | 0 | 0 | 0 | 0 | 0 | 0 | 0 | 0 | 0 |
| 40 | 0 | 0 | 0 | 0 | 0 | 0 | 0 | 0 | 0 | 0 | 0 | 0 | 0 | 0 |
| 41 | 0 | 0 | 0 | 0 | 0 | 0 | 0 | 0 | 0 | 0 | 0 | 0 | 0 | 0 |
| 42 | 0 | 0 | 0 | 0 | 0 | 0 | 0 | 0 | 0 | 0 | 0 | 0 | 0 | 0 |
| 43 | 0 | 0 | 0 | 0 | 1 | 1 | 1 | 0 | 1 | 0 | 0 | 1 | 1 | 0 |
| 44 | 0 | 0 | 0 | 0 | 1 | 1 | 1 | 0 | 1 | 0 | 0 | 1 | 1 | 0 |
| 45 | 0 | 0 | 1 | 1 | 1 | 1 | 1 | 0 | 0 | 0 | 0 | 1 | 1 | 0 |
| 46 | 0 | 0 | 0 | 0 | 0 | 0 | 0 | 0 | 0 | 0 | 0 | 0 | 0 | 0 |
| 47 | 0 | 0 | 0 | 0 | 0 | 0 | 0 | 0 | 0 | 0 | 0 | 0 | 0 | 0 |
| 48 | 0 | 0 | 0 | 0 | 0 | 0 | 0 | 0 | 0 | 0 | 0 | 0 | 0 | 0 |
| 49 | 1 | 1 | 1 | 1 | 1 | 1 | 1 | 1 | 1 | 1 | 1 | 1 | 1 | 1 |
| 50 | 1 | 1 | 1 | 1 | 1 | 1 | 1 | 1 | 1 | 1 | 1 | 1 | 1 | 1 |
| 51 | 1 | 1 | 1 | 1 | 1 | 1 | 1 | 1 | 1 | 1 | 1 | 1 | 1 | 1 |
| 52 | 1 | 0 | 0 | 0 | 0 | 0 | 0 | 0 | 0 | 0 | 0 | 0 | 0 | 0 |
| 53 | 0 | 0 | 0 | 0 | 0 | 0 | 0 | 0 | 0 | 0 | 0 | 0 | 0 | 0 |
| 54 | 1 | 0 | 0 | 0 | 0 | 0 | 0 | 0 | 0 | 0 | 0 | 0 | 0 | 0 |
| 55 | 1 | 1 | 1 | 1 | 1 | 1 | 1 | 1 | 1 | 1 | 1 | 1 | 1 | 1 |
| 56 | 1 | 1 | 1 | 1 | 1 | 1 | 1 | 1 | 1 | 1 | 1 | 1 | 1 | 1 |
| 57 | 1 | 1 | 1 | 1 | 1 | 1 | 1 | 1 | 1 | 1 | 1 | 1 | 1 | 1 |
| 58 | 0 | 0 | 0 | 0 | 0 | 0 | 0 | 0 | 0 | 0 | 0 | 0 | 0 | 0 |
| 59 | 0 | 0 | 0 | 0 | 0 | 0 | 0 | 0 | 0 | 0 | 0 | 0 | 0 | 0 |
| 60 | 0 | 0 | 0 | 0 | 0 | 0 | 0 | 0 | 0 | 0 | 0 | 0 | 0 | 0 |
| 61 | 0 | 0 | 0 | 0 | 0 | 0 | 0 | 0 | 0 | 0 | 0 | 0 | 0 | 0 |
| 62 | 0 | 0 | 0 | 0 | 0 | 0 | 0 | 0 | 0 | 0 | 0 | 0 | 0 | 0 |
| 63 | 0 | 0 | 0 | 0 | 0 | 0 | 0 | 0 | 0 | 0 | 0 | 0 | 0 | 0 |
| 64 | 0 | 0 | 0 | 0 | 0 | 0 | 0 | 0 | 0 | 0 | 0 | 0 | 0 | 0 |
| 65 | 0 | 0 | 0 | 0 | 0 | 0 | 0 | 0 | 0 | 0 | 0 | 0 | 0 | 0 |
| 66 | 0 | 0 | 0 | 0 | 0 | 0 | 0 | 0 | 0 | 0 | 0 | 0 | 0 | 0 |
| 67 | 0 | 0 | 0 | 0 | 0 | 0 | 0 | 0 | 0 | 0 | 0 | 0 | 0 | 0 |
| 68 | 0 | 0 | 0 | 0 | 1 | 0 | 0 | 0 | 0 | 0 | 0 | 0 | 0 | 0 |
| 69 | 0 | 0 | 0 | 0 | 0 | 0 | 0 | 0 | 0 | 0 | 0 | 0 | 0 | 0 |
| 70 | 0 | 0 | 0 | 0 | 0 | 0 | 0 | 0 | 0 | 0 | 0 | 0 | 0 | 0 |
| 71 | 0 | 0 | 0 | 0 | 0 | 0 | 0 | 1 | 0 | 0 | 0 | 0 | 0 | 0 |
| 72 | 0 | 0 | 0 | 0 | 0 | 0 | 0 | 0 | 0 | 0 | 0 | 0 | 0 | 0 |
| 73 | 0 | 0 | 0 | 0 | 0 | 0 | 0 | 1 | 0 | 0 | 0 | 0 | 0 | 0 |
| 74 | 0 | 0 | 0 | 0 | 0 | 0 | 0 | 0 | 0 | 0 | 0 | 0 | 0 | 0 |
| 75 | 0 | 0 | 0 | 0 | 0 | 0 | 0 | 0 | 0 | 0 | 0 | 0 | 0 | 0 |
| 76 | 0 | 0 | 0 | 0 | 0 | 0 | 0 | 0 | 0 | 0 | 0 | 0 | 0 | 0 |
| 77 | 0 | 0 | 0 | 0 | 0 | 0 | 0 | 0 | 0 | 0 | 0 | 0 | 0 | 0 |
| 78 | 0 | 0 | 0 | 0 | 0 | 0 | 0 | 0 | 0 | 0 | 0 | 0 | 0 | 0 |
| 79 | 0 | 0 | 0 | 0 | 0 | 0 | 0 | 0 | 0 | 0 | 0 | 0 | 0 | 0 |
| 80 | 0 | 0 | 0 | 0 | 0 | 0 | 0 | 0 | 0 | 0 | 0 | 0 | 0 | 0 |
| 81 | 0 | 0 | 0 | 0 | 0 | 0 | 0 | 0 | 0 | 0 | 0 | 0 | 0 | 0 |
| 82 | 0 | 0 | 0 | 0 | 0 | 0 | 0 | 0 | 0 | 0 | 0 | 0 | 0 | 0 |
| 83 | 0 | 0 | 0 | 0 | 0 | 0 | 0 | 0 | 0 | 0 | 0 | 0 | 0 | 0 |
| 84 | 0 | 0 | 0 | 0 | 0 | 0 | 0 | 0 | 0 | 0 | 0 | 0 | 0 | 0 |
| 85 | 0 | 0 | 0 | 0 | 0 | 0 | 0 | 0 | 0 | 0 | 0 | 0 | 0 | 0 |
| 86 | 0 | 0 | 0 | 0 | 0 | 0 | 0 | 0 | 0 | 0 | 0 | 0 | 0 | 0 |
| 87 | 0 | 0 | 0 | 0 | 0 | 0 | 0 | 0 | 0 | 0 | 0 | 0 | 0 | 0 |
| 88 | 0 | 0 | 0 | 0 | 0 | 0 | 0 | 0 | 0 | 0 | 0 | 0 | 0 | 0 |
| 89 | 0 | 0 | 0 | 0 | 0 | 0 | 0 | 0 | 0 | 0 | 0 | 0 | 0 | 0 |
| 90 | 0 | 0 | 0 | 0 | 0 | 0 | 0 | 0 | 0 | 0 | 0 | 0 | 0 | 0 |
| 91 | 0 | 0 | 0 | 0 | 0 | 0 | 0 | 0 | 0 | 0 | 0 | 0 | 0 | 0 |
| 92 | 0 | 0 | 0 | 0 | 0 | 0 | 0 | 0 | 0 | 0 | 0 | 0 | 0 | 0 |
| 93 | 0 | 0 | 0 | 0 | 0 | 0 | 0 | 0 | 0 | 0 | 0 | 0 | 0 | 0 |
| 94 | 0 | 0 | 0 | 0 | 0 | 0 | 0 | 0 | 0 | 0 | 0 | 0 | 0 | 0 |
| 95 | 0 | 0 | 0 | 0 | 0 | 0 | 0 | 0 | 0 | 0 | 0 | 0 | 0 | 0 |
| 96 | 0 | 0 | 0 | 0 | 0 | 0 | 0 | 0 | 0 | 0 | 0 | 0 | 0 | 0 |
| 97 | 0 | 0 | 0 | 0 | 0 | 0 | 0 | 0 | 0 | 0 | 0 | 0 | 0 | 0 |
| 98 | 0 | 0 | 0 | 0 | 0 | 0 | 0 | 0 | 0 | 0 | 0 | 0 | 0 | 0 |
| 99 | 0 | 0 | 0 | 0 | 0 | 0 | 0 | 0 | 0 | 0 | 0 | 0 | 0 | 0 |
| 100 | 0 | 0 | 0 | 0 | 0 | 0 | 0 | 0 | 0 | 0 | 0 | 0 | 0 | 0 |
| 101 | 0 | 0 | 0 | 0 | 0 | 0 | 0 | 0 | 0 | 0 | 0 | 0 | 0 | 0 |
| 102 | 0 | 0 | 0 | 0 | 0 | 0 | 0 | 0 | 0 | 0 | 0 | 0 | 0 | 0 |
| 103 | 0 | 0 | 0 | 0 | 0 | 0 | 0 | 0 | 0 | 0 | 0 | 0 | 0 | 0 |

TABLE 48-continued

| transition number | Sam131 | Sam132 | Sam133 | Sam134 | Sam135 | Sam136 | Sam137 | Sam138 | Sam139 | Sam140 | Sam141 | Sam142 | Sam143 | Sam144 |
|---|---|---|---|---|---|---|---|---|---|---|---|---|---|---|
| 104 | 0 | 0 | 0 | 0 | 0 | 0 | 0 | 0 | 0 | 0 | 0 | 0 | 0 | 0 |
| 105 | 0 | 0 | 0 | 0 | 0 | 0 | 0 | 0 | 0 | 0 | 0 | 0 | 0 | 0 |
| 106 | 0 | 0 | 0 | 0 | 0 | 0 | 0 | 0 | 0 | 0 | 1 | 0 | 0 | 0 |
| 107 | 0 | 0 | 0 | 0 | 0 | 0 | 0 | 0 | 0 | 0 | 0 | 0 | 0 | 0 |
| 108 | 0 | 0 | 0 | 0 | 0 | 0 | 0 | 0 | 0 | 0 | 0 | 0 | 0 | 0 |
| 109 | 0 | 0 | 0 | 0 | 0 | 0 | 0 | 0 | 0 | 0 | 0 | 0 | 0 | 0 |
| 110 | 0 | 0 | 0 | 0 | 0 | 0 | 0 | 0 | 0 | 0 | 0 | 0 | 0 | 0 |
| 111 | 0 | 0 | 0 | 0 | 0 | 0 | 0 | 0 | 0 | 0 | 0 | 0 | 0 | 0 |
| 112 | 0 | 0 | 0 | 0 | 0 | 0 | 0 | 0 | 0 | 0 | 0 | 1 | 1 | 1 | 0 |
| 113 | 0 | 0 | 0 | 0 | 0 | 0 | 0 | 0 | 0 | 0 | 0 | 1 | 0 | 0 |
| 114 | 0 | 0 | 0 | 0 | 0 | 0 | 0 | 0 | 0 | 0 | 0 | 0 | 0 | 0 |
| 115 | 0 | 0 | 0 | 0 | 0 | 0 | 0 | 0 | 0 | 0 | 0 | 0 | 0 | 0 |
| 116 | 0 | 0 | 0 | 0 | 0 | 0 | 0 | 0 | 0 | 0 | 0 | 0 | 0 | 0 |
| 117 | 1 | 0 | 0 | 0 | 0 | 0 | 0 | 0 | 0 | 0 | 0 | 0 | 0 | 0 |
| 118 | 0 | 1 | 1 | 1 | 0 | 0 | 0 | 0 | 0 | 0 | 0 | 1 | 0 | 0 |
| 119 | 0 | 0 | 0 | 0 | 0 | 0 | 0 | 0 | 0 | 0 | 0 | 1 | 0 | 0 |
| 120 | 0 | 0 | 0 | 0 | 0 | 0 | 0 | 0 | 0 | 0 | 0 | 1 | 0 | 0 |
| 121 | 0 | 0 | 0 | 0 | 0 | 0 | 0 | 0 | 0 | 0 | 0 | 0 | 0 | 0 |
| 122 | 0 | 0 | 0 | 0 | 0 | 0 | 0 | 0 | 0 | 0 | 0 | 0 | 0 | 0 |
| 123 | 0 | 0 | 0 | 0 | 0 | 0 | 0 | 0 | 0 | 0 | 0 | 0 | 0 | 0 |
| 124 | 0 | 0 | 0 | 0 | 0 | 0 | 0 | 1 | 0 | 0 | 0 | 0 | 0 | 0 |
| 125 | 0 | 0 | 0 | 0 | 0 | 0 | 0 | 1 | 0 | 0 | 0 | 0 | 1 | 0 |
| 126 | 0 | 0 | 0 | 0 | 0 | 0 | 0 | 1 | 0 | 0 | 0 | 0 | 0 | 0 |
| 127 | 1 | 0 | 0 | 0 | 1 | 0 | 0 | 0 | 0 | 0 | 0 | 1 | 1 | 0 |
| 128 | 1 | 0 | 0 | 0 | 1 | 0 | 0 | 0 | 0 | 0 | 0 | 1 | 1 | 0 |
| 129 | 1 | 0 | 0 | 0 | 1 | 0 | 0 | 0 | 0 | 0 | 0 | 1 | 1 | 0 |
| 130 | 0 | 0 | 0 | 0 | 0 | 0 | 0 | 0 | 0 | 0 | 0 | 0 | 0 | 0 |
| 131 | 0 | 0 | 0 | 0 | 0 | 0 | 0 | 0 | 0 | 0 | 0 | 0 | 0 | 0 |
| 132 | 0 | 0 | 1 | 0 | 0 | 0 | 0 | 0 | 0 | 0 | 0 | 0 | 0 | 0 |
| 133 | 0 | 0 | 0 | 1 | 0 | 0 | 1 | 0 | 0 | 0 | 0 | 0 | 0 | 0 |
| 134 | 0 | 1 | 0 | 0 | 0 | 0 | 0 | 0 | 0 | 0 | 1 | 1 | 0 | 1 |
| 135 | 0 | 0 | 0 | 1 | 0 | 0 | 1 | 0 | 1 | 1 | 1 | 1 | 1 | 1 |
| 136 | 0 | 0 | 0 | 0 | 0 | 0 | 0 | 0 | 0 | 0 | 0 | 0 | 0 | 0 |
| 137 | 0 | 0 | 0 | 0 | 0 | 0 | 0 | 0 | 0 | 0 | 0 | 0 | 0 | 0 |
| 138 | 1 | 0 | 0 | 0 | 1 | 1 | 1 | 0 | 1 | 1 | 1 | 1 | 1 | 1 |
| 139 | 0 | 0 | 0 | 0 | 0 | 1 | 0 | 0 | 0 | 0 | 0 | 0 | 0 | 0 |
| 140 | 0 | 0 | 0 | 0 | 0 | 1 | 1 | 1 | 1 | 1 | 1 | 1 | 0 | 1 |
| 141 | 0 | 0 | 0 | 0 | 0 | 0 | 0 | 0 | 0 | 0 | 0 | 0 | 0 | 0 |
| 142 | 0 | 1 | 1 | 1 | 1 | 1 | 1 | 0 | 1 | 1 | 1 | 1 | 1 | 0 |
| 143 | 0 | 1 | 1 | 1 | 1 | 1 | 1 | 0 | 1 | 1 | 1 | 1 | 1 | 0 |
| 144 | 0 | 1 | 1 | 1 | 1 | 1 | 1 | 0 | 1 | 1 | 1 | 1 | 1 | 0 |
| 145 | 0 | 1 | 1 | 1 | 1 | 1 | 1 | 1 | 1 | 1 | 1 | 1 | 1 | 1 |
| 146 | 0 | 1 | 1 | 1 | 1 | 1 | 1 | 1 | 1 | 1 | 1 | 1 | 1 | 1 |
| 147 | 0 | 1 | 1 | 1 | 1 | 1 | 1 | 1 | 1 | 1 | 1 | 1 | 1 | 1 |
| 148 | 0 | 0 | 0 | 0 | 0 | 0 | 0 | 0 | 0 | 0 | 0 | 1 | 0 | 0 |
| 149 | 1 | 1 | 1 | 1 | 1 | 1 | 1 | 1 | 1 | 1 | 1 | 1 | 0 | 1 |
| 150 | 0 | 0 | 0 | 0 | 0 | 0 | 0 | 0 | 0 | 0 | 0 | 1 | 0 | 0 |
| 151 | 0 | 0 | 0 | 0 | 0 | 0 | 0 | 0 | 0 | 0 | 0 | 0 | 0 | 1 |
| 152 | 0 | 0 | 0 | 0 | 0 | 1 | 0 | 0 | 0 | 0 | 0 | 0 | 0 | 1 |
| 153 | 0 | 0 | 0 | 0 | 0 | 0 | 0 | 0 | 0 | 0 | 0 | 0 | 0 | 1 |
| 154 | 0 | 0 | 0 | 0 | 0 | 0 | 0 | 0 | 0 | 0 | 0 | 0 | 0 | 0 |
| 155 | 0 | 0 | 0 | 0 | 0 | 0 | 0 | 0 | 0 | 0 | 0 | 0 | 0 | 0 |
| 156 | 0 | 0 | 0 | 0 | 0 | 0 | 0 | 0 | 0 | 0 | 0 | 0 | 0 | 0 |
| 157 | 0 | 0 | 0 | 0 | 0 | 0 | 0 | 0 | 0 | 0 | 0 | 0 | 0 | 0 |
| 158 | 0 | 0 | 0 | 0 | 0 | 0 | 0 | 0 | 1 | 0 | 0 | 0 | 1 | 0 |
| 159 | 0 | 0 | 0 | 0 | 0 | 0 | 0 | 0 | 1 | 0 | 0 | 0 | 1 | 0 |
| 160 | 1 | 0 | 0 | 0 | 1 | 1 | 1 | 0 | 1 | 0 | 0 | 1 | 1 | 0 |
| 161 | 1 | 1 | 1 | 0 | 1 | 1 | 1 | 1 | 1 | 0 | 0 | 1 | 1 | 0 |
| 162 | 0 | 0 | 0 | 0 | 1 | 1 | 1 | 0 | 0 | 0 | 0 | 1 | 1 | 0 |
| 163 | 0 | 0 | 0 | 0 | 1 | 0 | 0 | 0 | 0 | 0 | 0 | 0 | 0 | 0 |
| 164 | 0 | 0 | 0 | 0 | 0 | 0 | 0 | 0 | 0 | 0 | 0 | 0 | 0 | 0 |
| 165 | 1 | 0 | 0 | 0 | 0 | 0 | 0 | 0 | 0 | 0 | 0 | 0 | 0 | 0 |
| 166 | 0 | 0 | 0 | 0 | 0 | 0 | 0 | 0 | 0 | 0 | 0 | 0 | 0 | 0 |
| 167 | 0 | 0 | 0 | 0 | 0 | 0 | 0 | 0 | 0 | 0 | 0 | 0 | 0 | 0 |
| 168 | 0 | 0 | 0 | 0 | 0 | 0 | 0 | 0 | 0 | 0 | 0 | 0 | 0 | 0 |
| 169 | 0 | 0 | 0 | 0 | 0 | 0 | 0 | 0 | 0 | 0 | 0 | 0 | 0 | 0 |
| 170 | 0 | 0 | 0 | 0 | 0 | 0 | 0 | 0 | 0 | 0 | 0 | 0 | 0 | 0 |
| 171 | 0 | 0 | 0 | 0 | 0 | 0 | 0 | 0 | 0 | 0 | 0 | 0 | 0 | 0 |
| 172 | 0 | 0 | 0 | 0 | 0 | 0 | 0 | 1 | 0 | 0 | 0 | 0 | 0 | 0 |
| 173 | 0 | 0 | 0 | 0 | 0 | 0 | 0 | 0 | 1 | 0 | 0 | 0 | 0 | 0 |
| 174 | 0 | 0 | 0 | 0 | 0 | 1 | 0 | 0 | 1 | 0 | 1 | 0 | 0 | 1 |
| 175 | 0 | 0 | 0 | 0 | 0 | 0 | 0 | 0 | 0 | 0 | 0 | 0 | 0 | 0 |
| 176 | 0 | 0 | 1 | 0 | 0 | 0 | 0 | 0 | 0 | 0 | 0 | 0 | 0 | 0 |
| 177 | 0 | 0 | 0 | 0 | 0 | 0 | 0 | 0 | 0 | 0 | 0 | 0 | 0 | 0 |
| 178 | 0 | 0 | 0 | 0 | 0 | 0 | 0 | 0 | 0 | 0 | 0 | 0 | 0 | 0 |
| 179 | 0 | 0 | 0 | 0 | 0 | 0 | 0 | 0 | 0 | 0 | 0 | 0 | 0 | 0 |
| 180 | 0 | 0 | 0 | 0 | 0 | 0 | 0 | 0 | 0 | 0 | 0 | 0 | 0 | 0 |

TABLE 48-continued

| transition number | Sam131 | Sam132 | Sam133 | Sam134 | Sam135 | Sam136 | Sam137 | Sam138 | Sam139 | Sam140 | Sam141 | Sam142 | Sam143 | Sam144 |
|---|---|---|---|---|---|---|---|---|---|---|---|---|---|---|
| 181 | 0 | 0 | 0 | 0 | 0 | 0 | 1 | 0 | 0 | 0 | 0 | 1 | 1 | 0 |
| 182 | 1 | 0 | 0 | 0 | 1 | 1 | 1 | 0 | 1 | 0 | 0 | 1 | 1 | 0 |
| 183 | 0 | 0 | 0 | 0 | 1 | 1 | 1 | 0 | 0 | 0 | 0 | 1 | 1 | 0 |
| 184 | 0 | 0 | 0 | 0 | 0 | 0 | 0 | 0 | 0 | 0 | 0 | 0 | 0 | 0 |
| 185 | 0 | 0 | 0 | 0 | 0 | 0 | 0 | 0 | 0 | 0 | 0 | 0 | 0 | 0 |
| 186 | 0 | 0 | 0 | 0 | 0 | 0 | 0 | 0 | 0 | 0 | 0 | 0 | 0 | 0 |
| 187 | 0 | 0 | 0 | 0 | 0 | 0 | 0 | 0 | 0 | 0 | 0 | 0 | 0 | 0 |
| 188 | 0 | 0 | 0 | 0 | 0 | 0 | 0 | 0 | 0 | 0 | 0 | 0 | 0 | 0 |
| 189 | 0 | 0 | 0 | 0 | 0 | 0 | 0 | 0 | 0 | 0 | 0 | 0 | 0 | 0 |
| 190 | 0 | 0 | 0 | 0 | 0 | 0 | 0 | 0 | 0 | 0 | 0 | 0 | 0 | 0 |
| 191 | 0 | 0 | 0 | 0 | 0 | 0 | 0 | 0 | 0 | 0 | 0 | 0 | 0 | 0 |
| 192 | 0 | 0 | 0 | 0 | 0 | 0 | 0 | 0 | 0 | 0 | 0 | 0 | 0 | 0 |
| 193 | 0 | 0 | 0 | 0 | 0 | 0 | 0 | 0 | 0 | 0 | 0 | 0 | 0 | 0 |
| 194 | 0 | 0 | 0 | 0 | 0 | 0 | 0 | 0 | 0 | 0 | 0 | 0 | 0 | 0 |
| 195 | 0 | 0 | 0 | 0 | 0 | 0 | 0 | 0 | 0 | 0 | 0 | 0 | 0 | 0 |
| 196 | 0 | 0 | 0 | 0 | 0 | 0 | 0 | 0 | 0 | 0 | 0 | 0 | 0 | 0 |
| 197 | 0 | 0 | 0 | 0 | 0 | 0 | 0 | 0 | 0 | 0 | 0 | 0 | 0 | 0 |
| 198 | 0 | 0 | 0 | 0 | 0 | 0 | 0 | 0 | 0 | 0 | 0 | 0 | 0 | 0 |
| 199 | 0 | 0 | 0 | 0 | 0 | 0 | 0 | 0 | 0 | 0 | 0 | 0 | 0 | 0 |
| 200 | 0 | 0 | 0 | 0 | 0 | 0 | 0 | 0 | 0 | 0 | 0 | 0 | 0 | 0 |
| 201 | 0 | 0 | 0 | 0 | 0 | 0 | 0 | 1 | 0 | 0 | 0 | 0 | 0 | 0 |
| 202 | 0 | 0 | 0 | 0 | 0 | 0 | 0 | 0 | 0 | 0 | 0 | 0 | 0 | 0 |
| 203 | 0 | 0 | 0 | 0 | 0 | 0 | 0 | 0 | 0 | 0 | 0 | 0 | 0 | 0 |
| 204 | 0 | 0 | 0 | 0 | 0 | 0 | 0 | 0 | 0 | 0 | 0 | 0 | 0 | 0 |
| 205 | 1 | 1 | 1 | 1 | 1 | 0 | 1 | 1 | 0 | 0 | 0 | 0 | 0 | 0 |
| 206 | 1 | 1 | 1 | 1 | 1 | 0 | 1 | 1 | 0 | 1 | 1 | 1 | 0 | 0 |
| 207 | 1 | 1 | 1 | 1 | 1 | 1 | 0 | 1 | 0 | 1 | 1 | 1 | 0 | 1 |
| 208 | 0 | 0 | 0 | 0 | 0 | 0 | 0 | 0 | 0 | 0 | 0 | 0 | 0 | 0 |
| 209 | 0 | 0 | 0 | 0 | 0 | 0 | 0 | 0 | 0 | 0 | 0 | 0 | 0 | 0 |
| 210 | 0 | 0 | 0 | 0 | 0 | 0 | 0 | 0 | 0 | 0 | 0 | 0 | 0 | 0 |
| 211 | 0 | 0 | 0 | 0 | 0 | 0 | 0 | 0 | 0 | 0 | 0 | 0 | 0 | 0 |
| 212 | 0 | 0 | 0 | 0 | 0 | 0 | 0 | 0 | 0 | 0 | 0 | 0 | 1 | 0 |
| 213 | 0 | 0 | 0 | 0 | 0 | 0 | 0 | 0 | 1 | 0 | 0 | 0 | 1 | 0 |
| 214 | 0 | 0 | 0 | 0 | 0 | 0 | 0 | 0 | 0 | 0 | 0 | 0 | 0 | 0 |
| 215 | 0 | 0 | 0 | 0 | 0 | 0 | 0 | 0 | 0 | 0 | 0 | 0 | 0 | 0 |
| 216 | 0 | 0 | 0 | 0 | 0 | 0 | 0 | 0 | 0 | 0 | 0 | 0 | 0 | 0 |
| 217 | 0 | 0 | 0 | 0 | 0 | 0 | 0 | 0 | 0 | 0 | 0 | 0 | 1 | 0 |
| 218 | 0 | 1 | 0 | 0 | 0 | 1 | 0 | 0 | 0 | 0 | 1 | 1 | 0 | 0 |
| 219 | 0 | 0 | 1 | 1 | 0 | 0 | 0 | 0 | 0 | 0 | 0 | 0 | 0 | 0 |
| 220 | 0 | 0 | 0 | 0 | 0 | 0 | 0 | 0 | 0 | 0 | 0 | 0 | 0 | 0 |
| 221 | 0 | 0 | 0 | 0 | 0 | 0 | 0 | 0 | 0 | 0 | 0 | 0 | 0 | 0 |
| 222 | 0 | 0 | 0 | 0 | 0 | 0 | 0 | 0 | 0 | 0 | 0 | 0 | 0 | 0 |
| 223 | 0 | 0 | 0 | 0 | 0 | 0 | 0 | 0 | 0 | 0 | 0 | 0 | 0 | 0 |
| 224 | 0 | 0 | 0 | 0 | 0 | 0 | 0 | 0 | 0 | 0 | 0 | 0 | 0 | 0 |
| 225 | 0 | 0 | 0 | 0 | 0 | 0 | 0 | 0 | 0 | 0 | 0 | 0 | 0 | 0 |
| 226 | 1 | 0 | 0 | 0 | 0 | 0 | 1 | 1 | 0 | 0 | 0 | 0 | 0 | 0 |
| 227 | 0 | 0 | 0 | 0 | 0 | 0 | 0 | 0 | 0 | 0 | 0 | 0 | 0 | 0 |
| 228 | 1 | 0 | 0 | 0 | 0 | 0 | 1 | 0 | 0 | 1 | 0 | 0 | 0 | 0 |
| 229 | 0 | 0 | 0 | 0 | 0 | 0 | 0 | 0 | 0 | 0 | 0 | 0 | 0 | 0 |
| 230 | 0 | 0 | 0 | 0 | 0 | 0 | 0 | 0 | 0 | 0 | 0 | 0 | 0 | 0 |
| 231 | 0 | 0 | 0 | 0 | 0 | 0 | 0 | 0 | 0 | 0 | 0 | 0 | 0 | 0 |
| 232 | 0 | 0 | 1 | 0 | 1 | 1 | 1 | 0 | 0 | 0 | 0 | 1 | 1 | 0 |
| 233 | 0 | 0 | 1 | 0 | 1 | 1 | 1 | 0 | 0 | 0 | 0 | 1 | 1 | 0 |
| 234 | 0 | 0 | 0 | 0 | 1 | 1 | 1 | 0 | 0 | 0 | 0 | 1 | 1 | 0 |
| 235 | 0 | 0 | 0 | 0 | 0 | 0 | 0 | 0 | 0 | 0 | 0 | 0 | 0 | 0 |
| 236 | 0 | 0 | 0 | 0 | 0 | 0 | 0 | 0 | 0 | 0 | 0 | 0 | 0 | 0 |
| 237 | 0 | 0 | 0 | 0 | 0 | 0 | 0 | 0 | 0 | 0 | 0 | 0 | 0 | 0 |
| 238 | 0 | 0 | 0 | 0 | 0 | 0 | 0 | 0 | 0 | 0 | 0 | 0 | 0 | 0 |
| 239 | 0 | 0 | 0 | 0 | 0 | 0 | 0 | 0 | 0 | 0 | 0 | 0 | 0 | 0 |
| 240 | 0 | 0 | 0 | 0 | 0 | 0 | 0 | 0 | 0 | 0 | 0 | 0 | 0 | 0 |
| 241 | 1 | 1 | 1 | 1 | 1 | 1 | 1 | 1 | 1 | 1 | 1 | 1 | 1 | 1 |
| 242 | 1 | 1 | 1 | 1 | 1 | 1 | 1 | 0 | 1 | 0 | 1 | 1 | 1 | 1 |
| 243 | 1 | 1 | 1 | 1 | 1 | 1 | 1 | 0 | 1 | 0 | 1 | 1 | 1 | 1 |
| 244 | 0 | 0 | 0 | 0 | 0 | 0 | 0 | 0 | 1 | 0 | 0 | 0 | 0 | 0 |
| 245 | 0 | 0 | 0 | 0 | 1 | 0 | 0 | 0 | 0 | 0 | 0 | 0 | 0 | 0 |
| 246 | 0 | 0 | 0 | 0 | 0 | 0 | 0 | 0 | 0 | 0 | 0 | 0 | 0 | 0 |
| 247 | 1 | 0 | 1 | 0 | 1 | 1 | 1 | 0 | 1 | 0 | 1 | 1 | 1 | 0 |
| 248 | 1 | 1 | 1 | 1 | 1 | 1 | 1 | 1 | 1 | 1 | 1 | 1 | 1 | 1 |
| 249 | 1 | 1 | 1 | 1 | 1 | 1 | 1 | 0 | 1 | 1 | 1 | 1 | 1 | 1 |
| 250 | 0 | 0 | 0 | 0 | 0 | 0 | 0 | 0 | 0 | 0 | 0 | 0 | 0 | 0 |
| 251 | 0 | 1 | 1 | 1 | 0 | 0 | 0 | 0 | 0 | 0 | 0 | 0 | 0 | 0 |
| 252 | 0 | 0 | 0 | 0 | 0 | 0 | 0 | 0 | 0 | 0 | 0 | 0 | 0 | 0 |
| 253 | 0 | 0 | 0 | 0 | 1 | 0 | 1 | 0 | 1 | 0 | 0 | 1 | 1 | 0 |
| 254 | 0 | 0 | 0 | 0 | 1 | 0 | 1 | 0 | 1 | 0 | 0 | 1 | 1 | 0 |
| 255 | 0 | 0 | 0 | 0 | 1 | 0 | 1 | 0 | 1 | 0 | 0 | 1 | 1 | 0 |
| 256 | 0 | 0 | 0 | 0 | 0 | 0 | 0 | 0 | 0 | 0 | 0 | 0 | 0 | 0 |
| 257 | 0 | 0 | 0 | 0 | 0 | 0 | 0 | 0 | 0 | 0 | 0 | 0 | 0 | 0 |

TABLE 48-continued

| transition number | Sam131 | Sam132 | Sam133 | Sam134 | Sam135 | Sam136 | Sam137 | Sam138 | Sam139 | Sam140 | Sam141 | Sam142 | Sam143 | Sam144 |
|---|---|---|---|---|---|---|---|---|---|---|---|---|---|---|
| 258 | 0 | 0 | 0 | 0 | 0 | 0 | 0 | 0 | 0 | 0 | 0 | 0 | 0 | 0 |
| 259 | 0 | 0 | 0 | 0 | 0 | 0 | 0 | 0 | 0 | 0 | 0 | 0 | 0 | 0 |
| 260 | 0 | 0 | 0 | 0 | 0 | 0 | 0 | 0 | 0 | 0 | 0 | 0 | 0 | 0 |
| 261 | 0 | 0 | 0 | 0 | 0 | 0 | 0 | 0 | 0 | 0 | 0 | 0 | 0 | 0 |
| 262 | 0 | 0 | 0 | 0 | 0 | 0 | 0 | 0 | 0 | 0 | 0 | 1 | 1 | 0 |
| 263 | 0 | 0 | 0 | 0 | 0 | 0 | 0 | 0 | 0 | 0 | 1 | 0 | 1 | 0 |
| 264 | 0 | 0 | 0 | 0 | 0 | 0 | 0 | 0 | 0 | 0 | 0 | 1 | 0 | 0 |
| 265 | 0 | 0 | 0 | 0 | 0 | 0 | 0 | 0 | 0 | 0 | 0 | 0 | 0 | 0 |
| 266 | 0 | 0 | 0 | 0 | 0 | 0 | 0 | 0 | 0 | 0 | 0 | 0 | 0 | 0 |
| 267 | 0 | 0 | 0 | 0 | 0 | 1 | 0 | 0 | 0 | 0 | 0 | 0 | 0 | 0 |
| 268 | 0 | 0 | 0 | 0 | 0 | 0 | 0 | 0 | 0 | 0 | 0 | 0 | 0 | 0 |
| 269 | 0 | 0 | 0 | 0 | 0 | 0 | 0 | 0 | 0 | 0 | 0 | 0 | 0 | 0 |
| 270 | 0 | 0 | 0 | 0 | 0 | 0 | 0 | 0 | 0 | 0 | 0 | 0 | 0 | 0 |
| 271 | 0 | 0 | 0 | 0 | 0 | 0 | 0 | 0 | 0 | 0 | 0 | 0 | 0 | 0 |
| 272 | 0 | 0 | 0 | 0 | 0 | 0 | 0 | 0 | 0 | 1 | 0 | 0 | 0 | 0 |
| 273 | 0 | 0 | 0 | 0 | 0 | 0 | 0 | 0 | 0 | 1 | 0 | 0 | 0 | 0 |
| 274 | 0 | 0 | 0 | 0 | 0 | 0 | 0 | 0 | 0 | 0 | 0 | 0 | 0 | 0 |
| 275 | 0 | 0 | 0 | 0 | 0 | 0 | 0 | 0 | 0 | 0 | 0 | 0 | 0 | 0 |
| 276 | 0 | 0 | 0 | 0 | 0 | 0 | 0 | 0 | 0 | 0 | 0 | 0 | 0 | 0 |
| 277 | 0 | 0 | 0 | 0 | 0 | 0 | 0 | 0 | 0 | 0 | 0 | 0 | 0 | 0 |
| 278 | 0 | 0 | 0 | 0 | 0 | 0 | 0 | 0 | 0 | 0 | 0 | 0 | 0 | 0 |
| 279 | 0 | 0 | 0 | 0 | 0 | 0 | 0 | 0 | 0 | 0 | 0 | 0 | 0 | 0 |
| 280 | 0 | 0 | 0 | 0 | 1 | 0 | 0 | 0 | 0 | 0 | 0 | 0 | 0 | 0 |
| 281 | 0 | 0 | 0 | 0 | 0 | 0 | 0 | 0 | 0 | 0 | 0 | 0 | 0 | 0 |
| 282 | 0 | 0 | 0 | 0 | 1 | 0 | 0 | 0 | 0 | 0 | 0 | 0 | 0 | 0 |
| 283 | 0 | 0 | 0 | 0 | 1 | 1 | 1 | 0 | 0 | 0 | 0 | 1 | 1 | 0 |
| 284 | 0 | 1 | 1 | 0 | 0 | 1 | 1 | 0 | 0 | 0 | 0 | 1 | 1 | 0 |
| 285 | 0 | 0 | 0 | 0 | 0 | 1 | 1 | 0 | 0 | 0 | 0 | 1 | 1 | 0 |
| 286 | 0 | 0 | 0 | 0 | 0 | 0 | 0 | 0 | 0 | 0 | 0 | 0 | 0 | 0 |
| 287 | 0 | 0 | 0 | 0 | 0 | 0 | 0 | 0 | 0 | 0 | 0 | 0 | 0 | 0 |
| 288 | 0 | 0 | 0 | 0 | 0 | 0 | 0 | 0 | 0 | 0 | 0 | 0 | 0 | 0 |
| 289 | 0 | 0 | 0 | 0 | 0 | 0 | 0 | 0 | 0 | 0 | 0 | 0 | 0 | 0 |
| 290 | 0 | 0 | 0 | 0 | 0 | 0 | 0 | 0 | 0 | 0 | 0 | 0 | 0 | 0 |
| 291 | 0 | 0 | 0 | 0 | 0 | 0 | 0 | 0 | 0 | 0 | 0 | 0 | 0 | 0 |
| 292 | 0 | 0 | 0 | 0 | 0 | 0 | 0 | 0 | 0 | 0 | 0 | 0 | 0 | 0 |
| 293 | 0 | 0 | 0 | 0 | 0 | 0 | 0 | 0 | 0 | 0 | 0 | 0 | 0 | 0 |
| 294 | 0 | 0 | 0 | 0 | 0 | 0 | 0 | 0 | 0 | 0 | 0 | 0 | 0 | 0 |

Samples Sam131 to Sam144 comprise at least one peptide which is characteristic of the SHV proteins. The bacteria present in samples Sam131 to Sam144 therefore express a beta-lactamase which confers on them a resistance to penicillins.

Sample Sam142 comprises a peptide specific to phenotype 2be. Therefore sample Sam142 is resistant to penicillins, to cephalosporins and to monobactams.

No peptide specific to phenotypes 2b and 2br is observed, no sample tested is identified as belonging only to these phenotypes.

The detection methods described in examples 6 to 30 are particularly advantageous because they make it possible to assay a large number of peptides and at the same time to detect the presence of one or more resistance mechanisms induced by one or more beta-lactamases.

Furthermore, the detection is performed in a short time, less than one hour. In fact, only the part of the gradient between 3 and 34 minutes is useful to the analysis. Furthermore, the retention times of the assayed peptides are all below 34 minutes.

In addition, the detection methods described in examples 6 to 30 are more advantageous than the molecular biology methods because they detect the product of the expression of the genes, and not the genes themselves. The detection of a resistance may not have any clinical meaning if this gene is not expressed, or it if is expressed too weakly to lead to an effective resistance. The detection of a peptide characterising a protein characteristic of a resistance mechanism does not have this disadvantage.

Surprisingly, the above examples show that it is possible to attain by mass spectrometry the sensitivity necessary for the specific detection of the existence of a mechanism of resistance to at least one antimicrobial of a microorganism contained in a sample, without employing an amplification method as is usually the case when molecular biology methods are used.

BIBLIOGRAPHIC REFERENCES

[1] J. Anhalt & C. Fenselau, 1975, Anal. Chem., 47(2):219-225.
[2] A. Fox et al., ed., 1990, Analytical microbiology methods: chromatography and mass spectrometry, Plenum Press, New York, N.Y.
[3] M. Claydon et al., 1996, Nature Biotech. 14:1584-1586.
[4] T. Krishnamurthy & P. Ross, 1996, Rapid Com. Mass Spec., 10:1992-1996.
[5] P. Seng et al. 2009, Clin. Infect. Dis., 49:543-551.
[6] C. Fenselau et al., 2008, Appl. Environ. Microbiol., 904-906.
[7] S. Hofstadler et al., 2005, Int. J Mass Spectrom., 242: 23-41.
[8] D. Ecker, 2008, Nat. Rev. Microbiol., 6(7):553-558.
[9] Bush and Jacoby, 2010, Antimicrobial Agents and Chemotherapy; 54(3): 969-976
[10] W.-J. Chen et al., 2008, Anal. Chem., 80: 9612-9621
[11] D. Lopez-Ferrer et al., 2008, Anal. Chem., 80:8930-8936
[12] D. Lopez-Ferrer et al., 2005, J. Proteome res., 4(5): 1569-1574

[13] T. Fortin et al., 2009, Mol. Cell Proteomics, 8(5): 1006-1015.
[14] H. Keshishian et al., 2007, Mol. Cell Proteomics, 2212-2229.
[15] J. Stal-Zeng et al., 2007, Mol. Cell Proteomics, 1809-1817.
[16] Gaskell, Electrospray: principles and practise, 1997, J. Mass Spectrom., 32, 677-688).
[17] V. Fusaro et al., 2009, Nature Biotech. 27, 190-198.
[18] J. Mead et al., 15 Nov. 2008, Mol. Cell Proteomics, E-pub.
[19] F. Desiere et al., 2006, Nucleic Acids Res., 34(database issue): D655-8).
[20] L. Anderson & C. Hunter, 2006, Mol. Cell Proteomics, 573-588).
[21] B. Han & R. Higgs, 2008, Brief Funct Genomic Proteomic., 7(5):340-54).
[22] K.-Y. Wang et al., 2008, Anal. Chem, 80(16) 6159-6167).
[23] J. Bundy & C. Fenselau, 1999, Anal. Chem. 71: 1460-1463.
[24] K-C Ho et al., 2004, Anal. Chem. 76: 7162-7268.
[25] Y. S. Lin et al., 2005, Anal. Chem., 77: 1753-1760.
[26] S. Vaidyanathan et al., 2001, Anal. Chem., 73:4134-4144.
[27] R. Everley et al., 2009, J. Microbiol. Methods, 77:152-158.
[28] P. Seng et al., 2009, Clin. Infect. Dis., 49:543-551.
[29] Manes N. et al., 2007, Mol. & Cell. Proteomics, 6(4): 717-727.
[30] R. Nandakumar et al., 2009, Oral Microbiology Immunology, 24:347-352).
[31] L. Hernychova et al., 2008, Anal. Chem., 80:7097-7104.
[32] J.-M. Pratt et al., 2006, Nat. Protoc., 1:1029-1043.
[33] V. Brun et al., 2007, Mol. Cell Proteomics, 2139-2149.

SEQUENCE LISTING (2171 sequences)

SEQ ID NO: 1 - protein, 286 aa, Unknown [sequence omitted]

SEQ ID NO: 2 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 3 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 4 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYMTGSQATMDERNRQIAEIGASLIKHW

SEQ ID NO: 5 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSRGIIAALGPDGKPSRIVVIYTTGSQATMDERNRQIAEIGASLIKHW

SEQ ID NO: 6 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 7 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 8 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 9 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 10 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 11 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 12 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 13 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 14 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 15 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 16 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 17 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 18 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 19 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 20 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLRNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 21 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGGSERGSRGIIAALGPDGKPSRIVVIYTTGSQATMDERNRQIAEIGASLIKHW

SEQ ID NO: 22 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSRGIIAALGPDGKPSRIVVIYTTGSQATMDERNRQIAEIGASLIKHW

SEQ ID NO: 23 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYMTGSQATMDERNRQIAEIGASLIKHW

SEQ ID NO: 24 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 25 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGKRGSRGIIAALGPDGKPSRIVVIYMTGSQATMDERNRQIAEIGASLIKHW

SEQ ID NO: 26 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 27 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 28 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSSGIIAALGPDGKPSRIVVIYTTGSQATMDERNRQIAEIGASLIKHW

SEQ ID NO: 29 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSCGIIAALGPDGKPSRIVVIYTTGSQATMDERNRQIAEIGASLIKHW

SEQ ID NO: 30 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMISTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 31 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 32 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 33 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 34 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 35 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMISTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 36 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDELNRQIAEIGASLIKHW

SEQ ID NO: 37 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRREPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 38 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMISTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 39 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSTGIIAALGPDGKPSRIVVIYTTGSQATMDERNRQIAEIGASLIKHW

SEQ ID NO: 40 - protein, 286 aa, Unknown
  Resistance Marker For Multiple Organisms
MSIQHFRVALIPFFAAFCLPVFAHPETLVKVKDAEDKLGVRVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYMTGSQATMDERNRQIAEIGASLIKHW

SEQ ID NO: 41 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 42 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSSGIIAALGPDGKPSRIVVIYTTGSQATMDERNRQIAEIGASLIKHW

SEQ ID NO: 43 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDEQNRQIAEIGASLIKHW

SEQ ID NO: 44 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 45 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYMTGSQATMDERNRQIAEIGASLIKHW

SEQ ID NO: 46 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYMTGSQATMDERNRQIAEIGASLIKHW

SEQ ID NO: 47 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYMTGGQATMDERNRQIAEIGASLIKHW

SEQ ID NO: 48 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERDRQIAEIGASLIKHW

SEQ ID NO: 49 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSHGIIAALGPDGKPSRIVVIYTTGSQATMDERNRQIAEIGASLIKHW

SEQ ID NO: 50 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 51 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 52 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSLGIIAALGPDGKPSRIVVIYTTGSQATMDERNRQIAEIGASLIKHW

SEQ ID NO: 53 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAEPLLRSALPAGWFIADKSGAGERGSRGIIAALGPDGKPSRIVVIYTTGSQATMDERNRQIAEIGASLIKHW

SEQ ID NO: 54 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLRNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 55 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLDRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 56 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSSGIIAALGPDGKPSRIVIIYTTGSQATMDERNRQIAEIGASLIKHW

SEQ ID NO: 57 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMGDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 58 - protein, 286 aa, Unknown
  Resistance Marker For Multiple Organisms
MSIQHFRVALIPFFAAFCLPVFAHPETLVKVKDAEDKLGARVGYIELDPNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 59 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 60 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 61 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSCGIIAALGPDGKPSRIVVIYTTGSQATMDERNRQIAEIGASLIKHW

SEQ ID NO: 62 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLDRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 63 - protein, 286 aa, Unknown
  Resistance Marker For Multiple Organisms
MSIQHFRVALIPFFAAFCIPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSCGIIAALGPDGKPSRIVVIYTTGSQATMDERNRQIAEIGASLIKHW

SEQ ID NO: 64 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYMTGSQATMDELNRQIAEIGASLIKHW

SEQ ID NO: 65 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASQQQLIDWMEADKVAGPLLRSALPAGWFIADKSGAGERGSRGIIAALGPDGKPSRIVVIYTTGSQATMDERNRQIAEIGASLIKHW

SEQ ID NO: 66 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYTTGSQATMDERNRQIAEIGASLIKHW

SEQ ID NO: 67 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASKRGSRGIIAALGPDGKPSRIVVIYTTGSQATMDERNRQIAEIGASLIKHW

SEQ ID NO: 68 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSCGIIAALGPDGKPSRIVVIYMTGSQATMDERNRQIAEIGASLIKHW

SEQ ID NO: 69 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSSGIIAALGPDGKPSRIVVIYMTGSQATMDERNRQIAEIGASLIKHW

SEQ ID NO: 70 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 71 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMGDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 72 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSSGIIAALGPDGKPSRIVVIYTTGSQATMDERNRQIAEIGASLIKHW

SEQ ID NO: 73 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRREPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 74 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSGGIIAALGPDGKPSRIVVIYTTGSQATMDERNRQIAEIGASLIKHW

SEQ ID NO: 75 - protein, 289 aa, Unknown
  Resistance Marker For Multiple Organisms
  Xaa (67)..(67): Unknown
  Xaa (126)..(126): Unknown
  Xaa (274)..(274): Unknown
MSIQHFRVALIPFFAAFCLPVFAHPETLVKVKDAEDQLGARVGYIELDLNSGKILESFRPEERFPMXLSTFKVLLCGAVLSRVDAGQEQLGRRIHYSQNDLVEYSPVTEKHLTDGMTVRELCSAAXVTMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERXDRQIAEIGASLIKHW

SEQ ID NO: 76 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAVTMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 77 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDEQNRQIAEIGASLIKHW

SEQ ID NO: 78 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRCEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDEQNRQIAEIGASLIKHW

SEQ ID NO: 79 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 80 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGKRGSRGIIAALGPDGKPSRIVVIYMTGSQATMDERNRQIAEIGASLIKHW

SEQ ID NO: 81 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSRGIIAALGPDGKPSRIVVIYMTGSQATMDERNRQIAEIGASLIKHW

SEQ ID NO: 82 - protein, 286 aa, Unknown
  Resistance Marker For Multiple Organisms
MSIKHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLHCWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 83 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTDELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 84 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMGDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 85 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTGGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 86 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDCWEPELNEAIPNDERDTTTPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 87 - protein, 286 aa, Unknown
  Resistance Marker For Multiple Organisms
MSIKHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 88 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASKRGSRGIIAALGPDGKPSRIVVIYTTGSQATMDERNRQIAEIGASLIKHW

SEQ ID NO: 89 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASERGSRGIIAALGPDGKPSRIVVIYMTGSQATMDERNRQIAEIGASLIKHW

SEQ ID NO: 90 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGAKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 91 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLGRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 92 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASKRGSRGIIAALGPDGKPSRIVVIYTTGSQATMDERNRQIVEIGASLIKHW

SEQ ID NO: 93 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 94 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDELNRQIAEIGASLIKHW

SEQ ID NO: 95 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIVEIGASLIKHW

SEQ ID NO: 96 - protein, 287 aa, Unknown
  Resistance Marker For Multiple Organisms
  Xaa (122)..(122): Unknown
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCXNAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 97 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 98 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTTPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 99 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAELSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTSELLTLASRQQLIDWMEADKVAGPLLRSALPAGWFIADKSGAGERGSRGIIAALGPDGKPSRIVVIYTTGSQATMDERSRQIAEIGASLIKHW

SEQ ID NO: 100 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 101 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 102 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGADERGSRGIIAALGPDGKPSRIVVIYMTGSQATMDERNRQIAEIGASLIKHW

SEQ ID NO: 103 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLRNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 104 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 105 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSRGIIAALGPDGKPSRIVVIYTTGSQATMDERNRQIAEIGASLIKHW

SEQ ID NO: 106 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 107 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 108 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 109 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 110 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 111 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSSGIIAALGPDGKPSRIVVIYTTGSQATMDERNRQIAEIGASLIKHW

SEQ ID NO: 112 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDEQNRQIAEIGASLIKHW

SEQ ID NO: 113 - protein, 286 aa, Unknown
  Resistance Marker For Multiple Organisms
MSIKHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 114 - protein, 286 aa, Unknown
  Resistance Marker For Multiple Organisms
MSIKHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 115 - protein, 286 aa, Unknown
  Resistance Marker For Multiple Organisms
MSIQHFRVALIPFLAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSREPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 116 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERETTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 117 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDNVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 118 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGEHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 119 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 120 - protein, 286 aa, Unknown
  Resistance Marker For Multiple Organisms
MSIQHFRVALIPFFAAFCLPVFAHPETLVKVKPAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGERGSRGIIAALGPDGKPSRIVVIYTTGSQATMDERNRQIAEIGASLIKHW

SEQ ID NO: 121 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTTPAAMATTLRKLLTGELLTLASRQQLIDWMEADKVAGPLLRSALPAGWFIADKSGTGERGSRGIIAALGPDGKPSRIVVIYTTGSQATMDERNRQIAEIGASLIKHW

SEQ ID NO: 122 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAVPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 123 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 124 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 125 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 126 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGTGKRGSRGIIAALGPDGKPSRIVVIYTTGGQATMDERNRQIAEIGASLIKHW

SEQ ID NO: 127 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGRRGSRGIIAALGPDGKPSRIVVIYTTGSQATMDERNRQIAEIGASLIKHW

SEQ ID NO: 128 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPIDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 129 - protein, 286 aa, Unknown
  Resistance Marker For Multiple Organisms
MSIQHFRVALIPFFAAFCLPVFAHPETLVKVKDAEDKLGARVGYIEMDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGASERGSRGIIAALGPDGKPSRIVVIYTTGSQATMDERNRQIAEIGASLIKHW

SEQ ID NO: 130 - protein, 286 aa, Unknown
  Resistance Marker For Multiple Organisms
MSIQHFRVALIPFFAAFCLPVFAHPETLVKVEDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 131 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGANERGSRGIIAALGPDGKPSRIVVIYMTGSQATMDERNRQIAEIGASLIKHW

SEQ ID NO: 132 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDCWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 133 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDCWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 134 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLMRSALPAGWFIADKSGAGERGSHGIIAALGPDGKPSRIVVIYTTGSQATMDERNRQIAEIGASLIKHW

SEQ ID NO: 135 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLPDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSHGIIAALGPDGKPSRIVVIYTTGSQATMDERNRQIAEIGASLIKHW

SEQ ID NO: 136 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSVLPAGWFIADKSGAGERGSRGIIAALGPDGKPSRIVVIYTTGSQATMDERNRQIAEIGASLIKHW

SEQ ID NO: 137 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATKLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 138 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTTPAAMATTLRKLLTGELLTLASRQQLIDWMEADKVAGPLLRSALPAGWFIADKSGAGVRGSRGIIAALGPDGKPSRIVVIYTTGSQATMDERNRQIAEIGASLIKHW

SEQ ID NO: 139 - protein, 286 aa, Unknown
  Resistance Marker For Multiple Organisms
MSIQHFRVALIPFFAAFCLPVFAHPDTLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 140 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGGSLIKHW

SEQ ID NO: 141 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERDRQIAEIGASLIKHW

SEQ ID NO: 142 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 143 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGKRGSRGIIAALGPDGKPSRIVVIYTTGSQATMDERNRQIAEIGASLIKHW

SEQ ID NO: 144 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNIGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 145 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQSDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 146 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERDRQIAEIGASLIKHW

SEQ ID NO: 147 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMISTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 148 - protein, 286 aa, Unknown
  Resistance Marker For Multiple Organisms
MSIQHFRVALIPFFAAFCLPVFAHPETLVKVKDAEDKLGARVGYIELDLNSGKILESFRPEERFPMVSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 149 - protein, 286 aa, Unknown
  Resistance Marker For Multiple Organisms
MSIKHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDHWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 150 - protein, 286 aa, Unknown
  Resistance Marker For Multiple Organisms
MSIQHFRVALIPFFAAFCLPVFAHPKTLVKVKDAENQLGARVGYIELDLNSGKILESFRPEKRFPMMSTFKVLLCGAVLSRIDAGQEQLGRRIHYSQSDVVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 151 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDEQNRQIAEIGASLIKLW

SEQ ID NO: 152 - protein, 286 aa, Unknown
  Resistance Marker For Multiple Organisms
MSIQHFRVALIPFFAAFCLPVFAHPETLVKVKDAEDQVGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQTAEIGASLIKHW

SEQ ID NO: 153 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDSWEPELNEAIPNDERDTTTPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 154 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVGELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 155 - protein, 286 aa, Unknown
  Resistance Marker For Multiple Organisms
MSIQHFRVALIPFFAAFCFPVFAHPETLVKVKDAEDQLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSVLPAGWFIADKSGASERGSRGIIAALGPDGKPSRIVVIYMTGSQATMDERNRQIAEIGASLIKHW

SEQ ID NO: 156 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYMTGSQATMDERNRQIAEIGASLIKHW

SEQ ID NO: 157 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMLSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRGEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 158 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEICASLIKHW

SEQ ID NO: 159 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 160 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEVDKVAGPLLRSALPAGWFIADKSGAGERGSSGIIAALGPDGKPSRIVIIYTTGSQATMDERNRQIAEIGASLIKHW

SEQ ID NO: 161 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEVDKVAGPLLRSALPAGWFIADKSGAGERGSSGIIAALGPDGKPSRIVVIYTTGSQATMDERKRQIAEIGASLIKHW

SEQ ID NO: 162 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEVDKVAGPLLRSALPAGWFIADKSGAGERGSRGIIAALGPDGKPSRIVVIYTTGSQATMDERNRQIAEIGASLIKHW

SEQ ID NO: 163 - protein, 286 aa, Unknown
  Resistance Marker For Multiple Organisms
MSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPAAMATTLRKLLTGELLTLASRQQLIDWMEADKVAGPLLRSVLPAGWFIADKSGAGERGSRGIIAALGPDGKPSRIVVIYTTGSQATMDERNRQIAEIGASLIKHW

SEQ ID NO: 164 - protein, 286 aa, Unknown
  Resistance Marker For Multiple Organisms
MSIKHFRVALIPFFAAFCLPVFAHPETLVKVKDAEDKLGARVGYIELDLNSGKILESFRPEERFPMMSTFKVLLCGAVLSRVDAGQEQLGRRIHYSQNDLVKYSPVTEKHLTDGMTVRELCSAAITMSDNTAANLLLTTIGGPKELTAFLHNMGDHVTRLDSWEPELNEAIPNDERDTTTPAAMATTLRKLLTGELLTLASRQQLIDWMEADKVAGPLLRSALPAGWFIADKSGTGKRGSRGIIAALGPDGKPSRIVVIYTTGSQATMDERNRQIAEIGASLIKHW

SEQ ID NO: 165 - protein, 285 aa, Unknown
  Resistance Marker For Multiple Organisms
MSIQHFRVALIPFFAAFCLPVFAHPETLVKVKDAEDQLGSTSGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGSQELTAFLHNMGDHVTRLDRWEPELNEAIPNDEADTTMPAAMATTLRKLLTGELLTLASRQQLIDWMADKVAGPLLRSALPAGWFIADKSGARERGSRGIIAALGPDGKPSRIVVIYTTGSQATMDERNRQIAEIGASLIKHW

SEQ ID NO: 166 - protein, 14 aa, Unknown
  Resistance Marker For Multiple Organisms
CEPELNEAIPNDER

SEQ ID NO: 167 - protein, 9 aa, Unknown
  Resistance Marker For Multiple Organisms
DAEDQLGAR

SEQ ID NO: 168 - protein, 21 aa, Unknown
  Resistance Marker For Multiple Organisms
DAEDQLGSTSGYIELDLNSGK

SEQ ID NO: 169 - protein, 9 aa, Unknown
  Resistance Marker For Multiple Organisms
DAEDQVGAR

SEQ ID NO: 170 - protein, 9 aa, Unknown
  Resistance Marker For Multiple Organisms
DAENQLGAR

SEQ ID NO: 171 - protein, 11 aa, Unknown
  Resistance Marker For Multiple Organisms
DTTMPAAMATK

SEQ ID NO: 172 - protein, 13 aa, Unknown
  Resistance Marker For Multiple Organisms
DTTMPAAMATTLR

SEQ ID NO: 173 - protein, 13 aa, Unknown
  Resistance Marker For Multiple Organisms
DTTMPVAMATTLR

SEQ ID NO: 174 - protein, 13 aa, Unknown
  Resistance Marker For Multiple Organisms
DTTTPAAMATTLR

SEQ ID NO: 175 - protein, 15 aa, Unknown
  Resistance Marker For Multiple Organisms
ELTAFLHNIGDHVTR

SEQ ID NO: 176 - protein, 15 aa, Unknown
  Resistance Marker For Multiple Organisms
ELTAFLHNMGDHVTR

SEQ ID NO: 177 - protein, 15 aa, Unknown
  Resistance Marker For Multiple Organisms
ELTAFLHNMGDNVTR

SEQ ID NO: 178 - protein, 15 aa, Unknown
  Resistance Marker For Multiple Organisms
ELTAFLHNMGEHVTR

SEQ ID NO: 179 - protein, 7 aa, Unknown
  Resistance Marker For Multiple Organisms
ELTAFLR

SEQ ID NO: 180 - protein, 13 aa, Unknown
  Resistance Marker For Multiple Organisms
EPELNEAIPNDER

SEQ ID NO: 181 - protein, 13 aa, Unknown
  Resistance Marker For Multiple Organisms
ETTTPAAMATTLR

SEQ ID NO: 182 - protein, 8 aa, Unknown
  Resistance Marker For Multiple Organisms
FPMISTFK

SEQ ID NO: 183 - protein, 8 aa, Unknown
  Resistance Marker For Multiple Organisms
FPMLSTFK

SEQ ID NO: 184 - protein, 8 aa, Unknown
  Resistance Marker For Multiple Organisms
FPMMSTFK

SEQ ID NO: 185 - protein, 8 aa, Unknown
  Resistance Marker For Multiple Organisms
FPMVSTFK

SEQ ID NO: 186 - protein, 14 aa, Unknown
  Resistance Marker For Multiple Organisms
GEPELNEAIPNDER

SEQ ID NO: 187 - protein, 14 aa, Unknown
  Resistance Marker For Multiple Organisms
GIIAALGPDGKPSR

SEQ ID NO: 188 - protein, 17 aa, Unknown
  Resistance Marker For Multiple Organisms
GSCGIIAALGPDGKPSR

SEQ ID NO: 189 - protein, 17 aa, Unknown
  Resistance Marker For Multiple Organisms
GSGGIIAALGPDGKPSR

SEQ ID NO: 190 - protein, 17 aa, Unknown
  Resistance Marker For Multiple Organisms
GSHGIIAALGPDGKPSR

SEQ ID NO: 191 - protein, 17 aa, Unknown
  Resistance Marker For Multiple Organisms
GSLGIIAALGPDGKPSR

SEQ ID NO: 192 - protein, 17 aa, Unknown
  Resistance Marker For Multiple Organisms
GSSGIIAALGPDGKPSR

SEQ ID NO: 193 - protein, 17 aa, Unknown
  Resistance Marker For Multiple Organisms
GSTGIIAALGPDGKPSR

SEQ ID NO: 194 - protein, 9 aa, Unknown
  Resistance Marker For Multiple Organisms
HLPDGMTVR

SEQ ID NO: 195 - protein, 9 aa, Unknown
  Resistance Marker For Multiple Organisms
HLTDGMTVR

SEQ ID NO: 196 - protein, 9 aa, Unknown
  Resistance Marker For Multiple Organisms
HLTGGMTVR

SEQ ID NO: 197 - protein, 10 aa, Unknown
  Resistance Marker For Multiple Organisms
IDAGQEQLGR

SEQ ID NO: 198 - protein, 17 aa, Unknown
  Resistance Marker For Multiple Organisms
IHYSQNDLVEYSPVTEK

SEQ ID NO: 199 - protein, 10 aa, Unknown
  Resistance Marker For Multiple Organisms
IHYSQNDLVK

SEQ ID NO: 200 - protein, 17 aa, Unknown
  Resistance Marker For Multiple Organisms
IHYSQSDLVEYSPVTEK

SEQ ID NO: 201 - protein, 17 aa, Unknown
  Resistance Marker For Multiple Organisms
IHYSQSDVVEYSPVTEK

SEQ ID NO: 202 - protein, 10 aa, Unknown
  Resistance Marker For Multiple Organisms
ILESFRPEER

SEQ ID NO: 203 - protein, 9 aa, Unknown
  Resistance Marker For Multiple Organisms
ILESFRPEK

SEQ ID NO: 204 - protein, 16 aa, Unknown
  Resistance Marker For Multiple Organisms
IVIIYTTGSQATMDER

SEQ ID NO: 205 - protein, 16 aa, Unknown
  Resistance Marker For Multiple Organisms
IVVIYMTGGQATMDER

SEQ ID NO: 206 - protein, 18 aa, Unknown
  Resistance Marker For Multiple Organisms
IVVIYMTGSQATMDELNR

SEQ ID NO: 207 - protein, 16 aa, Unknown
  Resistance Marker For Multiple Organisms
IVVIYMTGSQATMDER

SEQ ID NO: 208 - protein, 16 aa, Unknown
  Resistance Marker For Multiple Organisms
IVVIYTTGGQATMDER

SEQ ID NO: 209 - protein, 18 aa, Unknown
  Resistance Marker For Multiple Organisms
IVVIYTTGSQATMDELNR

SEQ ID NO: 210 - protein, 18 aa, Unknown
  Resistance Marker For Multiple Organisms
IVVIYTTGSQATMDEQNR

SEQ ID NO: 211 - protein, 16 aa, Unknown
  Resistance Marker For Multiple Organisms
IVVIYTTGSQATMDER

SEQ ID NO: 212 - protein, 17 aa, Unknown
  Resistance Marker For Multiple Organisms
LDCWEPELNEAIPNDER

SEQ ID NO: 213 - protein, 17 aa, Unknown
  Resistance Marker For Multiple Organisms
LDHWEPELNEAIPNDER

SEQ ID NO: 214 - protein, 17 aa, Unknown
  Resistance Marker For Multiple Organisms
LDHWEPELNEAVPNDER

SEQ ID NO: 215 - protein, 17 aa, Unknown
  Resistance Marker For Multiple Organisms
LDSWEPELNEAIPNDER

SEQ ID NO: 216 - protein, 17 aa, Unknown
  Resistance Marker For Multiple Organisms
LHCWEPELNEAIPNDER

SEQ ID NO: 217 - protein, 12 aa, Unknown
  Resistance Marker For Multiple Organisms
LLTDELLTLASR

SEQ ID NO: 218 - protein, 23 aa, Unknown
  Resistance Marker For Multiple Organisms
LLTGELLTLASQQQLIDWMEADK

SEQ ID NO: 219 - protein, 12 aa, Unknown
  Resistance Marker For Multiple Organisms
LLTGELLTLASR

SEQ ID NO: 220 - protein, 12 aa, Unknown
  Resistance Marker For Multiple Organisms
LLTSELLTLASR

SEQ ID NO: 221 - protein, 7 aa, Unknown
  Resistance Marker For Multiple Organisms
MSIQHFR

SEQ ID NO: 222 - protein, 8 aa, Unknown
  Resistance Marker For Multiple Organisms
NMGDHVTR

SEQ ID NO: 223 - protein, 11 aa, Unknown
  Resistance Marker For Multiple Organisms
QIAEICASLIK

SEQ ID NO: 224 - protein, 11 aa, Unknown
  Resistance Marker For Multiple Organisms
QIAEIGASLIK

SEQ ID NO: 225 - protein, 11 aa, Unknown
  Resistance Marker For Multiple Organisms
QIAEIGGSLIK

SEQ ID NO: 226 - protein, 11 aa, Unknown
  Resistance Marker For Multiple Organisms
QIVEIGASLIK

SEQ ID NO: 227 - protein, 10 aa, Unknown
  Resistance Marker For Multiple Organisms
QQLIDWMADK

SEQ ID NO: 228 - protein, 11 aa, Unknown
  Resistance Marker For Multiple Organisms
QQLIDWMEADK

SEQ ID NO: 229 - protein, 11 aa, Unknown
  Resistance Marker For Multiple Organisms
QQLIDWMEVDK

SEQ ID NO: 230 - protein, 11 aa, Unknown
  Resistance Marker For Multiple Organisms
QTAEIGASLIK

SEQ ID NO: 231 - protein, 12 aa, Unknown
  Resistance Marker For Multiple Organisms
SALPAGWFIADK

SEQ ID NO: 232 - protein, 6 aa, Unknown
  Resistance Marker For Multiple Organisms
SGADER

SEQ ID NO: 233 - protein, 6 aa, Unknown
  Resistance Marker For Multiple Organisms
SGAGER

SEQ ID NO: 234 - protein, 6 aa, Unknown
  Resistance Marker For Multiple Organisms
SGAGVR

SEQ ID NO: 235 - protein, 6 aa, Unknown
  Resistance Marker For Multiple Organisms
SGANER

SEQ ID NO: 236 - protein, 6 aa, Unknown
  Resistance Marker For Multiple Organisms
SGASER

SEQ ID NO: 237 - protein, 5 aa, Unknown
  Resistance Marker For Multiple Organisms
SGASK

SEQ ID NO: 238 - protein, 6 aa, Unknown
  Resistance Marker For Multiple Organisms
SGGSER

SEQ ID NO: 239 - protein, 6 aa, Unknown
  Resistance Marker For Multiple Organisms
SGTGER

SEQ ID NO: 240 - protein, 12 aa, Unknown
  Resistance Marker For Multiple Organisms
SVLPAGWFIADK

SEQ ID NO: 241 - protein, 7 aa, Unknown
  Resistance Marker For Multiple Organisms
VAEPLLR

SEQ ID NO: 242 - protein, 7 aa, Unknown
  Resistance Marker For Multiple Organisms
VAGPLLR

SEQ ID NO: 243 - protein, 7 aa, Unknown
  Resistance Marker For Multiple Organisms
VAGPLMR

SEQ ID NO: 244 - protein, 23 aa, Unknown
  Resistance Marker For Multiple Organisms
VALIPFFAAFCFPVFAHPETLVK

SEQ ID NO: 245 - protein, 23 aa, Unknown
  Resistance Marker For Multiple Organisms
VALIPFFAAFCIPVFAHPETLVK

SEQ ID NO: 246 - protein, 23 aa, Unknown
  Resistance Marker For Multiple Organisms
VALIPFFAAFCLPVFAHPDTLVK

SEQ ID NO: 247 - protein, 23 aa, Unknown
  Resistance Marker For Multiple Organisms
VALIPFFAAFCLPVFAHPETLVK

SEQ ID NO: 248 - protein, 19 aa, Unknown
  Resistance Marker For Multiple Organisms
VALIPFFAAFCLPVFAHPK

SEQ ID NO: 249 - protein, 23 aa, Unknown
  Resistance Marker For Multiple Organisms
VALIPFLAAFCLPVFAHPETLVK

SEQ ID NO: 250 - protein, 10 aa, Unknown
  Resistance Marker For Multiple Organisms
VDAGQEQLDR

SEQ ID NO: 251 - protein, 10 aa, Unknown
  Resistance Marker For Multiple Organisms
VDAGQEQLGR

SEQ ID NO: 252 - protein, 11 aa, Unknown
  Resistance Marker For Multiple Organisms
VEDAEDQLGAR

SEQ ID NO: 253 - protein, 12 aa, Unknown
  Resistance Marker For Multiple Organisms
VGYIELDLNSGK

SEQ ID NO: 254 - protein, 12 aa, Unknown
  Resistance Marker For Multiple Organisms
VGYIELDPNSGK

SEQ ID NO: 255 - protein, 12 aa, Unknown
  Resistance Marker For Multiple Organisms
VGYIEMDLNSGK

SEQ ID NO: 256 - protein, 7 aa, Unknown
  Resistance Marker For Multiple Organisms
VKPAEDK

SEQ ID NO: 257 - protein, 10 aa, Unknown
  Resistance Marker For Multiple Organisms
VLLCGAELSR

SEQ ID NO: 258 - protein, 10 aa, Unknown
  Resistance Marker For Multiple Organisms
VLLCGAVLSR

SEQ ID NO: 259 - protein, 14 aa, Unknown
  Resistance Marker For Multiple Organisms
WEPELNEAIPIDER

SEQ ID NO: 260 - protein, 14 aa, Unknown
  Resistance Marker For Multiple Organisms
WEPELNEAIPNDER

SEQ ID NO: 261 - protein, 7 aa, Unknown
  Resistance Marker For Multiple Organisms
YSPVTEK

SEQ ID NO: 262 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGASVSEQTLFEIGSVSKTLTATLGAYAVVKGAMQLDDKASRHAPWLKGSVFDSITMGELATYSAGGLPLQFPEEVDSSEKMRAYYRQWAPVYSPGSHRQYSNPSIGLFGHLAASSLKQPFAQLMEQTLLPGLGMHHTYVNVPKQAMASYAYGYSKEDKPIRVNPGMLADEAYGIKTSSADLLAFVKANIGGVDDKALQQAISLTHKGHYSVGGMTQGLGWESYAYPVTEQTLLAGNSAKVILEANPTAAPRESGSQVLFNKTGSTNGFGAYVAFVPARGIGIVMLANRNYPIPARVKAAHAILAQLAG

SEQ ID NO: 263 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGAGVSEQTLFEIGSVSKTLTATLGAYAVVKGAMQLDDKASRHAPWLKGSAFDSITMGELATYSAGGLPLQFPEEVDSSEKMRAYYRQWAPVYSPGSHRQYSNPSIGLFGHLAASSLKQPFAPLMEQTLLPGLGMHHTYVNVPKQAMASYAYGYSKEDKPIRVNPGMLADEAYGIKTSSADLLRFVKANIGGVDDKALQQAISLTHQGHYSVGGMTQGLGWESYAYPVTEQTLLAGNSAKVILEANPTAAPRESGSQVLFNKTGSTNGFGAYVAFVPARGIGIVMLANRNYPIEARIKAAHAILAQLAG

SEQ ID NO: 264 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGAGVSEQTLFEIGSVSKTLTATLGAYAVVKGAMQLDDKASRHAPWLKGSAFDSITMGELATYSAGGLPLQFPEEVDSSEKMRAYYRQWAPVYSPGSHRQYSNPSIGLFGHLAASSLKQPFAPLMEQTLLPGLGMHHTYVNVPKQAMASYAYGYSKEDKPIRVNPGMLADEAYGIKTSSADLLRFVKANIGGVDDKALQQAISLTHQGHYSVGGMTQGLGWESYAYPVTEQTLLAGNSAKVSLEANPTAAPRESGSQVLFNKTGSTNGFGAYVAFVPARGIGIVMLANRNYPIEARIKAAHAILAQLAG

SEQ ID NO: 265 - protein, 381 aa, Unknown
  Resistance Marker For Multiple Organisms
MMKKSLCCALLLTASFSTFASAKTEQQIADIVNRTITPLMQEQAIPGMAVAIIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLRFYQNWQPQWAPGAKRLYANSSIGLFGALAVKPSGMSYEEAMTRRVLQPLKLAHTWITVPQNEQKDYAWGYREGKPVHVSPGQLDAEAYGVKSNVTDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 266 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVAFAALPAVEVNPPAPAVKASWVHKTGSTGGFGSYVAFVPEKNLGIVMLANKSYPNPVRVEAAWRILEKLQ

SEQ ID NO: 267 - protein, 383 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGNGSDSKVALAALPAVEVNPPAPAVKASWVHKTGSTGGFGSYVAFVPEKNLGIVMLANKSYPNPVRVEAAWRILEKLQ

SEQ ID NO: 268 - protein, 380 aa, Unknown
  Resistance Marker For Multiple Organisms
MKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDNKVALAALPAVEVNPPAPAVKASWVHKTGSTGGFGSYVAFVPEKNLGIVMLANKSYPNPVRVEAAWRILEKLQ

SEQ ID NO: 269 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGELAVKPSGMSYEEAMTRRVLQPLKLAHTWITVPQNEQKDYAWGYREGKPVHVSPGKLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 270 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAYWRILEKLQ

SEQ ID NO: 271 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAGAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 272 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 273 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKAVHVSPGQLDAEAYGVKSSVIDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 274 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVYVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 275 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGELAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDNKVALAALPAVEVNPPAPAVKASWVHKTGSTGGFGSYVAFVPEKNLGIVMLANKSYPNPVRVEAAWRILEKLQ

SEQ ID NO: 276 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGRLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 277 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQFPDDVRDKAALLHFYQNWQPQWTPGAKRLYANSSIGLFGELAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 278 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHGSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 279 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDCIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPENEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 280 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVTDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 281 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYACGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 282 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLRFYQNWQPQWTPGAKRLYANSSIGLFGTLAVKPSGMSYEEAMTRRVLQPLKLAHTWITVPQSEQKDYAWGYREGKPVHVSPGQLDAEAYGVKSSVIDMAHWVQANMDASHVQEKTLQQGIELAQSRYWRIGDMYQGLGWEMLNWPLKADSIINGSDSKVALAALPAVEVNPPAPAVKASWVHKTGYTGGFGSYVAFVPEKNLGIVMLANKSYPNPVRVEAAWRILEKLQ

SEQ ID NO: 283 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPEQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 284 - protein, 379 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVAALPAVEVNPPAPAVKASWVHKTGSTGGFGSYVAFVPEKNLGIVMLANKSYPNPVRVEAAWRILEKLQ

SEQ ID NO: 285 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFAALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 286 - protein, 377 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVAPAVEVNPPAPAVKASWVHKTGSTGGFGSYVAFVPEKNLGIVMLANKSYPNPVRVEAAWRILEKLQ

SEQ ID NO: 287 - protein, 381 aa, Unknown
  Resistance Marker For Multiple Organisms
MMKKSLCCALLLTASFSTFAAAKTEQQIADIVNRTITPLMQEQAIPGMAVAIIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLRFYQNWQPQWTPGAKRLYANSSIGLFGALAVKPSGMSYEEAMTRRVLQPLKLAHTWITVPQNEQKDYAWGYREGKPVHVTPGQLDAEAYGVKSNVTDMARWIQVNMDASRVQEKTLQQGIALAQSRYWRIGDMYQGLGWEMLNWPLKADSIINGSDSKVALAALHTVEVNPPAPAVKASWVHKTGSTGGFGSYVAFIPEKNLGIVMLANKSYPNPVRVEAAWRILEKLQ

SEQ ID NO: 288 - protein, 381 aa, Unknown
  Resistance Marker For Multiple Organisms
MMKKSICCALLLTASFSTFAAAKTEQQIADIVNRTITPLMQEQAIPGMAVAIIYEGKPYYFTWGKADIANNHPVTQQTLFELGSVSKTFNGVLGGDAIARGEIKLSDPVTKYWPELTGKQWRGISLLHLATYTAGGLPLQIPDEVTDKAELLRFYQNWQPQWTPGAKRLYANSSIGLFGALVVKPSGMSYEEAMTRRVLQPLKLAHTWITVPQSEQKNYAWGYREGKPVHVSPGQLDAEAYGVKSSVIDMARWVQANMDASHVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPARVEAAWRILEKLQ

SEQ ID NO: 289 - protein, 383 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLELDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 290 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGEAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 291 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQFDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 292 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKTDSIINGSDSKVALAALPAVEVNPPAPAVKASWVHKTGSTGGFGSYVAFVPEKNLGIVMLANKSYPNPVRVEAAWRILEKLQ

SEQ ID NO: 293 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGASVSEQTLFDIGSVSKTLTATLGAYAVVKGAMQLDDKASRHAPWLKGSVFDSITMGELATYSAGGLPLQFPEEVDSSEKMRAYYRQWAPVYSPGSHRQYSNPSIGLFGHLAASSLKQPFAQLMEQTLLPGLGMHHTYVNVPKQAMASYAYGYSKEDKPIRVNPGMLADEAYGIKTSSADLLAFVKANIGGVDDKALQQAISLTHKGHYSVGGMTQGLGWESYAYPVTEQTLLAGNSAKVILEANPTAAPRESGSQVLFNKTGSTNGFGAYVAFVPARGIGIVMLANRNYPIPARVKAAHAILAQLAG

SEQ ID NO: 294 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGASVSEQTLFDIGSVSKTLTATLGAYAVVKGAMQLDDKASRHAPWLKGSVFDSITMGELATYSAGGLPLQFPEEVDSSEKMRAYYRQWAPVYSPGSHRQYSNPSIGLFGHLAASSLKQPFAQLMEQTLLPGLGMHHTYVNVPKQAMASYAYGYSKEDKPIRVNPGMLADEAYGIKTSSADLLAFVKANIGGVDDKALQQAISLTHKGHYSVGGMTQGLGWESYAYPVTEQTLLAGNSAKVSLEANPTAAPRESGSQVLFNKTGSTNGFGAYVAFVPARGIGIVMLANRNYPIPARVKAAHAILAQLAG

SEQ ID NO: 295 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWSELTGKQWQGISLLHLATYTAGGLPLQIPDDVTDKTALLHFYQNWQPQWAPGAKRLYANSSIGLFGALAVKPSGMSYEEAMTRRVLQPLKLAHTWITVPQSEQKDYAWGYREGKPVHVSPGQLDAEAYGVKSSVIDMARWVQANMDASRVQEKTLQQGIALAQSRYWRIGDMYQGLGWEMLNWPLKADSIINGSDSKVALAAIPAVEVNPPAPAVKASWVHKTGSTGGFGSYVAFVPEKNLGIVMLANKSYPNPIRVEAAWRILEKLQ

SEQ ID NO: 296 - protein, 381 aa, Unknown
  Resistance Marker For Multiple Organisms
MMKKSLCCALLLTASFSTFASAKTEQQIADIVNRTITPLMQEQAIPGMAVAVIYQGKTYYFTWGKADIANNHPVTQQTLFELGSVSKTFNGVLGGDAIARGEIKLSDPVTKYWPELTGKQWQDISLLHLATYTAGGLPLQIPDDVTDKTALLHFYQNWQPQWAPGAKRLYANSSIGLFGALAVKPSGMSYEEAMTRRVLQPLKLAHTWITVPQSEQKDYAWGYREGKPVHVSPGQLDAEAYGVKSNVTDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 297 - protein, 381 aa, Unknown
  Resistance Marker For Multiple Organisms
MMKKSLCCALLLTAPLSTFAAAKTEQQIADIVNRTITPLMQEQAIPGMAVAVIYQGKPYYFTWGKADITNNHPVTQQTLFELGSVSKTFNGVLGGDAIARGEIKLSDPVTKYWPELTGKQWQGISLLHLATYTAGGLPLQIPDDVTDKAALLRFYQNWQPQWAPGAKRLYANSSIGLFGALAVKPSGMSYEEAMTRRVLQPLKLAHTWIKVPQSEQKDYAWGYREGKAVHVSPGQLDAEAYGVKSSVIDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 298 - protein, 381 aa, Unknown
  Resistance Marker For Multiple Organisms
MMKKSICCALLLTASFSTFAATKTEQQIADIVNRTITPLMQEQAIPGMAVAIIYEEKPYYFTWGKADIANNHPVTQQTLFELGSVSKTFNGVLGGDAIARGEIKLSDPVTKYWPELTGKQWRGISLLHLATYTAGGLPLQIPDEVTDKAALLRFYQNWQPQWTPGAKRLYANSSIGLFGALAVKPSGMSYEEAMTRRVLQPLKLAHTWITVPQSEQKNYAWGYREGKPVHVSPGQLDAEAYGVKSSVIDMARWVQANMDASHVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPARVEAAWRILEKLQ

SEQ ID NO: 299 - protein, 395 aa, Unknown
  Resistance Marker For Multiple Organisms
GPGHLFAFNYGTDFMMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHASPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 300 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 301 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGAGVSEQTLFEIGSVSKTLTATLGAYAVVKGAMQLDDKASRHAPWLKGSAFDSITMGELATYSAGGLPLQFPEEVDSSEKMRAYYRQWAPVYSPGSHRQYSNPSIGLFGHLAASSLKQPFAPLMEQTLLPGLGMHHTYVNVPKQAMASYAYGYSKEDKPIRVNPGMLADEAYGIKTSSADLLRFVKANIGGVDDKALQQAISLTHQGHYSVGGMTQGLGWESYAYPVTEQTLLAGNSAKVILEANPTAAPRESGSQVLFNKTGSTNGFGAYVAFVPARGIGIVMLANRNYPNEARIKAAHAILAQLAG

SEQ ID NO: 302 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 303 - protein, 381 aa, Unknown; identical to SEQ ID NO: 302
  Resistance Marker For Multiple Organisms

SEQ ID NO: 304 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYSNSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKNYPNPVRVEAAWRILEKLQ

SEQ ID NO: 305 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGELAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 306 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYALGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 307 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKFSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 308 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKNYPNPVRVEAAWRILEKLQ

SEQ ID NO: 309 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEINPPAPAVKASWVHKTGSTGGFGSYVAFVPEKNLGIVMLANKSYPNPVRVEAAWRILEKLQ

SEQ ID NO: 310 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYSNSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 311 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYARGYREGKPVHVSPGQLNAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKNYPNPVRVEAAWRILEKLQ

SEQ ID NO: 312 - protein, 19 aa, Unknown
  Resistance Marker For Multiple Organisms
AALLHFYQNWQPQWTPGAK

SEQ ID NO: 313 - protein, 22 aa, Unknown
  Resistance Marker For Multiple Organisms
ADIANNHPVTQQTLFELGSVSK

SEQ ID NO: 314 - protein, 11 aa, Unknown
  Resistance Marker For Multiple Organisms
ADSIINGSDSK

SEQ ID NO: 315 - protein, 6 aa, Unknown
  Resistance Marker For Multiple Organisms
ASWVHK

SEQ ID NO: 316 - protein, 7 aa, Unknown
  Resistance Marker For Multiple Organisms
DYAWGYR

SEQ ID NO: 317 - protein, 18 aa, Unknown
  Resistance Marker For Multiple Organisms
IGDMYQGLGWEMLNWPLK

SEQ ID NO: 318 - protein, 14 aa, Unknown
  Resistance Marker For Multiple Organisms
LAHTWITVPQNEQK

SEQ ID NO: 319 - protein, 21 aa, Unknown
  Resistance Marker For Multiple Organisms
LLHLATYTAGGLPLQIPDDVR

SEQ ID NO: 320 - protein, 7 aa, Unknown
  Resistance Marker For Multiple Organisms
LSDPVTK

SEQ ID NO: 321 - protein, 16 aa, Unknown
  Resistance Marker For Multiple Organisms
LYANSSIGLFGALAVK

SEQ ID NO: 322 - protein, 10 aa, Unknown
  Resistance Marker For Multiple Organisms
NLGIVMLANK

SEQ ID NO: 323 - protein, 6 aa, Unknown
  Resistance Marker For Multiple Organisms
QWQGIR

SEQ ID NO: 324 - protein, 19 aa, Unknown
  Resistance Marker For Multiple Organisms
SLCCALLLTASFSTFAAAK

SEQ ID NO: 325 - protein, 8 aa, Unknown
  Resistance Marker For Multiple Organisms
SSVIDMAR

SEQ ID NO: 326 - protein, 7 aa, Unknown
  Resistance Marker For Multiple Organisms
SYPNPVR

SEQ ID NO: 327 - protein, 11 aa, Unknown
  Resistance Marker For Multiple Organisms
TEQQIADIVNR

SEQ ID NO: 328 - protein, 13 aa, Unknown
  Resistance Marker For Multiple Organisms
TFNGVLGGDAIAR

SEQ ID NO: 329 - protein, 17 aa, Unknown
  Resistance Marker For Multiple Organisms
TGSTGGFGSYVAFVPEK

SEQ ID NO: 330 - protein, 23 aa, Unknown
  Resistance Marker For Multiple Organisms
TITPLMQEQAIPGMAVAVIYQGK

SEQ ID NO: 331 - protein, 12 aa, Unknown
  Resistance Marker For Multiple Organisms
TLQQGIALAQSR

SEQ ID NO: 332 - protein, 19 aa, Unknown
  Resistance Marker For Multiple Organisms
VALAALPAVEVNPPAPAVK

SEQ ID NO: 333 - protein, 6 aa, Unknown
  Resistance Marker For Multiple Organisms
VEAAWR

SEQ ID NO: 334 - protein, 6 aa, Unknown
  Resistance Marker For Multiple Organisms
VLQPLK

SEQ ID NO: 335 - protein, 14 aa, Unknown
  Resistance Marker For Multiple Organisms
WVQANMDASHVQEK

SEQ ID NO: 336 - protein, 8 aa, Unknown
  Resistance Marker For Multiple Organisms
YWPELTGK

SEQ ID NO: 337 - protein, 11 aa, Unknown
  Resistance Marker For Multiple Organisms
AHYFNYGVANR

SEQ ID NO: 338 - protein, 9 aa, Unknown
  Resistance Marker For Multiple Organisms
ANIGGVDDK

SEQ ID NO: 339 - protein, 10 aa, Unknown
  Resistance Marker For Multiple Organisms
ESGSQVLFNK

SEQ ID NO: 340 - protein, 8 aa, Unknown
  Resistance Marker For Multiple Organisms
GAMQLDDK

SEQ ID NO: 341 - protein, 10 aa, Unknown
  Resistance Marker For Multiple Organisms
GIGIVMLANR

SEQ ID NO: 342 - protein, 6 aa, Unknown
  Resistance Marker For Multiple Organisms
HAPWLK

SEQ ID NO: 343 - protein, 10 aa, Unknown
  Resistance Marker For Multiple Organisms
IPGMAVAVLK

SEQ ID NO: 344 - protein, 12 aa, Unknown
  Resistance Marker For Multiple Organisms
PVVDASIQPLLK

SEQ ID NO: 345 - protein, 12 aa, Unknown
  Resistance Marker For Multiple Organisms
QAMASYAYGYSK

SEQ ID NO: 346 - protein, 12 aa, Unknown
  Resistance Marker For Multiple Organisms
QWAPVYSPGSHR

SEQ ID NO: 347 - protein, 19 aa, Unknown
  Resistance Marker For Multiple Organisms
QYSNPSIGLFGHLAASSLK

SEQ ID NO: 348 - protein, 17 aa, Unknown
  Resistance Marker For Multiple Organisms
TGSTNGFGAYVAFVPAR

SEQ ID NO: 349 - protein, 13 aa, Unknown
  Resistance Marker For Multiple Organisms
TLTATLGAYAVVK

SEQ ID NO: 350 - protein, 14 aa, Unknown
  Resistance Marker For Multiple Organisms
VNPGMLADEAYGIK

SEQ ID NO: 351 - protein, 291 aa, Unknown
  Resistance Marker For Multiple Organisms
MMTQSIRRSMLTVMATLPLLFSSATLHAQTNSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWGVGDKTGSGDYGTTNDIAVIWPANHAPLVLVTYFTQPEQKAESRRDVLAAAAKIVTHGF

SEQ ID NO: 352 - protein, 291 aa, Unknown
  Resistance Marker For Multiple Organisms
MMRHRVKRMMLMTTACISLLLGSAPLYAQANDVQQKLAALEKSSGGRLGVALIDTADNAQTLYRADERFAMCSTSKVMAAAAVLKQSETQKKVLSQKVEIKSSDLINYNPITEKHVNGTMTLAELSAAALQYSDNTAMNKLIAHLGGPDKVTAFARAIGDNTFRLDRTEPTLNTAIPGDPRDTTTPLAMAQTLRNLTLGSALGETQRAQLVTWLKGNTTGAASIQAGLPTSWVVGDKTGSGDYGTTNDIAVIWPEGRAPLILVTYFTQPEQKAESRRDVLAAAAKIVTDGY

SEQ ID NO: 353 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTAGDKTGSGDYGTTNDIAVIWPQGRAPLVLVTYFTQPQQNAESRRDVLASAARIIAEGL

SEQ ID NO: 354 - protein, 291 aa, Unknown
  Resistance Marker For Multiple Organisms
MVKKSLRQFTLMATATVTLLLGSVPLYAQTVDVQQKLAELEQQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 355 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 356 - protein, 291 aa, Unknown
  Resistance Marker For Multiple Organisms
MVTKRMQRMMFAAAACIPLLLGSAPLYAQTSAVQQKLAALEKSSGGRLGVALIDTKDNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFAREIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 357 - protein, 282 aa, Unknown
  Resistance Marker For Multiple Organisms
MVKKSLRQFTLMATATVTLLLGSVPLYAQTADVQQKLAGLERQSGGRLGVALINTADNSQILYRADERFAMCSTSKVMAAAAVLKKSESEPNLLNQRVEIKKSDLVNYNPIAEKHVNGTMSPAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRHVLAS

SEQ ID NO: 358 - protein, 291 aa, Unknown
  Resistance Marker For Multiple Organisms
MVKKSLRQFTLMATAAVTLLLGSVPLYAQTADVQQKLAELERQSGGRLGVALINTADNSQILYRADERFAMCSTSKVMAAAAVLKKSESEPSLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDILASAAKIVTDGL

SEQ ID NO: 359 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTAGDKTGSGGYGTTNDIAVIWPQGRAPLVLVTYFTQPQQNAESRRDVLASAARIIAEGL

SEQ ID NO: 360 - protein, 291 aa, Unknown; identical to SEQ ID NO: 355
  Resistance Marker For Multiple Organisms

SEQ ID NO: 361 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTESTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 362 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAKGL

SEQ ID NO: 363 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 364 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 365 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTETTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 366 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAVAAVLKQSETQKGLLSQRVEIKPSDLINYNPIAEKHVNGTMTFGELSAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIQAGLPTSWVVGDKTGSGGYGTTNDIAVIWPEGRAPLVLVTYFTQSEPKAESRRDVLAAAARIVTDGY

SEQ ID NO: 367 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAERRRDVLASAARIIAEGL

SEQ ID NO: 368 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAAAAVLKQSETQKGLLSQRVEIKPSDLINYNPIAEKHVNGTMTFGELSAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIRAGLPTSWVVGDKTGSGDYGTTNDIAVIWPEGRAPLVLVTYFTQSEPKAESRRDVLAAAARIVTDGY

SEQ ID NO: 369 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGGYGTTNDIAVIWPQGRAPLVLVTYFTQPQQNAESRRDVLASAARIIAEGL

SEQ ID NO: 370 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYSPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 371 - protein, 291 aa, Unknown
  Resistance Marker For Multiple Organisms
MVKKSLRQFTLMATAAVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVDGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTNGL

SEQ ID NO: 372 - protein, 291 aa, Unknown
  Resistance Marker For Multiple Organisms
MVKKSLRQFTLMATAAVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVDGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 373 - protein, 291 aa, Unknown
  Resistance Marker For Multiple Organisms
MVKKSLRQFTLMATATVTLLLGSVPLYAQTVDVQQKLAELEQQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSCDYGTTNDIAVIWPKDRAPLILVTYFTQPQPKAESRRDVLASAAKIVTDGL

SEQ ID NO: 374 - protein, 291 aa, Unknown
  Resistance Marker For Multiple Organisms
MVKKSLRQFTLMATATVTLLLGSVPLHAQTADVQQKLAELEQQSGGRLGVALINTADNSQILYRADERFAMCSTSKVMAAAAVLKKSESEPNLLNQRVEIKKSDLVNYNPIAEKHVDGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 375 - protein, 290 aa, Unknown
  Resistance Marker For Multiple Organisms
MRHRVKRMMLMTTACISLLLGSAPLYAQANDVQQKLAALEKSSGGRLGVALIDTADNAQTLYRADERFAMCSTSKVMAAAAVLKQSETQKNVLSQKVEIKSSDLINYNPIAEKHVNGTMTLAELSAAALQYSDNTAMNKLIAHLGGPDKVTAFARAIGDDTFRLDRTEPTLNTAIPGDPRDTTTPLAMAQTLRHLTLGSALGETQRAQLVTWLKGNTTGAASIQAGLPTSWVVGDKTGSGDYGTTNDIAVIWPEGRAPLILVTYFTQPEQKAESRRDVLAAAAKIVTDGY

SEQ ID NO: 376 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAARIRAGLPTSWTVGDKTGSGDYGTTNDIAVIWPQGRAPLVLVTYFTQPQQNAESRRDVLASAARIIAEGL

SEQ ID NO: 377 - protein, 291 aa, Unknown
  Resistance Marker For Multiple Organisms
MVTKRVQRMMFAAAACIPLLLGSAPLYAQTSAVQQKLAALEKSSGRRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 378 - protein, 291 aa, Unknown
  Resistance Marker For Multiple Organisms
MVTKRVQRMMFAAAACIPLLLGSAPLYAQTNAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 379 - protein, 291 aa, Unknown
  Resistance Marker For Multiple Organisms
MVTKRVQRMMFAAAACIPLLLGSAPLYAQTSAVQQKLAALEKSSGRRLGVPLIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 380 - protein, 291 aa, Unknown
  Resistance Marker For Multiple Organisms
MVTKRVQRMMFAAAACIPLLLGSAPLYAQTSAVQQKLAALEKSSGGRLGVPLIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 381 - protein, 291 aa, Unknown
  Resistance Marker For Multiple Organisms
MVTKRVQRMMFAAAACIPLLLGSAPLYAQTNAVQQKLAALEKSSGGRLGVPLIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 382 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDGTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 383 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAAAAVLKQSETQKGLLSQRVEIKPSDLINYNPIAEKHVNGTMTFGELSAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIQAGLPTSWVVGDKTGSGDYGTTNDIAVIWPEGRAPLVLVTYFTQSEPKAESRRDVLAAAARIVTDGY

SEQ ID NO: 384 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAAAAVLKQSETQKGLLSQRVEIKPSDLVNYNPIAEKHVNGTMTFGELIAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIQAGLPTSWVVGDKTGSGGYGTTNDIAVIWPEGRAPLVLVTYFTQSEPKAESRRDVLAAAARIVTDGY

SEQ ID NO: 385 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTETTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 386 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGGYGTTNDIAVIWPENHAPLVLVTYFTQPEQKAERRRDILAAAAKIVTHGF

SEQ ID NO: 387 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTAGDKTGSGDYGTTNDIAVIWPQGRAPLVLVTYFTQPQQNAESRRDVLASAARIIAEGL

SEQ ID NO: 388 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTESTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 389 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFPMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 390 - protein, 291 aa, Unknown
  Resistance Marker For Multiple Organisms
MVKKSLRQFTLMATATVTLLLGSVPLYAQTVDVQQKLAELEQQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVIYFTQPQPKAESRRDVLASAAKIVTDGL

SEQ ID NO: 391 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEQTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 392 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKLLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 393 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 394 - protein, 291 aa, Unknown; identical to SEQ ID NO: 393
  Resistance Marker For Multiple Organisms

SEQ ID NO: 395 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVDGTMSLAELSAAALQYSDNVAMNKLISHVGGPASVTAFARQLGDETFRLDRTETTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 396 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVDGTMSLAELSAAALQYSDNVAMNKLISHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 397 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAENRRDILAAAAKIVTHGF

SEQ ID NO: 398 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAERRRDVLASAARIIAEGL

SEQ ID NO: 399 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTNGL

SEQ ID NO: 400 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTESTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 401 - protein, 291 aa, Unknown
  Resistance Marker For Multiple Organisms
MVKKSLRQFTLMATATVTLLLGNVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 402 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYSPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 403 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLEQSETQKQLLNQPVEIQPADLVNYNPIAEKHVNGTMTLAELSAAALQYSDHTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 404 - protein, 291 aa, Unknown
  Resistance Marker For Multiple Organisms
MVKKSLRQFTLMATATVTLLLGSVPLHAQTVDVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDDTFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 405 - protein, 291 aa, Unknown
  Resistance Marker For Multiple Organisms
MVKKSLRQFTLMATATVTLLLGSVPLYAQTVDVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 406 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPNAESRRDVLASAAKIVTNGL

SEQ ID NO: 407 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTELTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 408 - protein, 291 aa, Unknown
  Resistance Marker For Multiple Organisms
MVTKRVQRMMFAAAACIPLLLGSAPLYAQTSAVQQKLAALEKSSGGRLGVALIDTADNTHVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 409 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVAWLKGNTTGAASIRAGLPTSWTVGDKTGSGDYGTTNDIAVIWPQGRAPLVLVTYFTQPQQNAESRRDVLASAARIIAEGL

SEQ ID NO: 410 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTPAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 411 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPFAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 412 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRHDVLASAAKIVTDGL

SEQ ID NO: 413 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 414 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAVAAVLKQSETQKGLLSQRVEIKPSDLINYNPIAEKHVNGTMTFGELSAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIQAGLPTSWVVGDKTGSGDYGTTNDIAVIWPEGRAPLVLVTYFTQSEPKAESRRDVLAAAARIVTDGY

SEQ ID NO: 415 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTETTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 416 - protein, 291 aa, Unknown
  Resistance Marker For Multiple Organisms
MMTQSIRRSMLTVMATLSLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 417 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSCGYGTTNDIAVIWPKDRAPLILVTYFTQPQPKAESRRDVLASAAKIVTDGL

SEQ ID NO: 418 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAVAAVLKQSETQKGLLSQRVEIKPSDLINYNPIAEKHVNGTMTFGELSAAALQYSDNTAMNKLIAHLGGPDKVTAFARTIGDDTFRLDRTEPTLNTAIPGDPRDTTTPLAMAQSLRNLTLGNALGDTQRAQLVMWLKGNTTGAASIQAGLPTSWVVGDKTGSGDYGTTNDIAVIWPEGRAPLVLVTYFTQSEPKAESRRDVLAAAARIVTDGY

SEQ ID NO: 419 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRTQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 420 - protein, 291 aa, Unknown
  Resistance Marker For Multiple Organisms
MMRKSVRRAMLMTTACVSLLLASVPLCAQANDVQQKLAALEKSSGGRLGVALINTADNTQTLYRADERFAMCSTSKVMAAAAVLKQSETQKGLLSQRVEIKPSDLINYNPIAEKHVNGTMTLGELSAAALQYSDNTAMNKLIAHLGGPDKVTAFARTIGDDTFRLDRTEPTLNTAIPGDPRDTTTPLAMAQALRNLTLGNALGDTQRAQLVMWLKGNTTGAASIQAGLPTSWVVGDKTGSGGYGTTNDIAVIWPEGRAPLVLVTYFTQSEPKAESRRDVLAAAARIVTDGY

SEQ ID NO: 421 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTESTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAERRRDVLASAARIIAEGL

SEQ ID NO: 422 - protein, 291 aa, Unknown
  Resistance Marker For Multiple Organisms
MMTQSIGRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 423 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGGYGTTNDIAVIWPQGRAPLVLVTYFTQPQQNAESRRDVLASAARIIAEGL

SEQ ID NO: 424 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAERRRDILAAAAKIVTHGF

SEQ ID NO: 425 - protein, 289 aa, Unknown
  Resistance Marker For Multiple Organisms
MVTKRVQRMMSAAAACIPLLLGSPTLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTARAGADVASLRWVMRWAKPSGAVGDVAQRQYDRAAGIRAGLPTSWTVGDKTGSGDYGTTNDIAVIWPQGRAPLVLVTYFTQPQQNAESRRDVLASAARIIAEGL

SEQ ID NO: 426 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVDGTMSLAELSAAALQYSDNVAMNKLISHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 427 - protein, 290 aa, Unknown
  Resistance Marker For Multiple Organisms
MRHRVKRMMLMTTACISLLLGSAPLYAQANDVQQKLAALEKSSGGRLGVALIDTADNAQTLYRADERFAMCSTSKVMAAAAVLKQSETQKNVLSQKVEIKSSDLINYNPIAEKHVNGTMTLAELSAAALQYSDNTAMNKLIAHLGGPDKVTAFARAIGDDTFRLDRTEPTLNTAIPGDPRDTTTPLAMAQTLRHLTLGSALGETQRAQLVTWLKGNTTGAASIQAGLPTSWVVGDKTGSGDYGTTNDIAVIWPEGRAPLILVTYFTQPEQKAENRRDVLAAAAKIVTDGY

SEQ ID NO: 428 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPASWVVGDKTGSGGYGTTNDIAVIWPKDRAPLILVTYFTQPQPKAESRRDVLASAAKIVTDGL

SEQ ID NO: 429 - protein, 291 aa, Unknown
  Resistance Marker For Multiple Organisms
MMTQSIRRSMLTVMATLPLLFSSATLHAQANSVQQQLEALEKSSGGRLGVALINTADNSQILYLADERFAMCSTSKVMAAAAVLKQSESDKHLLNQRVEIKASDLVNYNPIAEKHVNGTMTLAELGAGALQYSDNTAMNKLIAHLGGPDKVTAFARSLGDETFRLDRTEPTLNSAIPGDPRDTTTPLAMAQTLKNLTLGKALAETQRAQLVTWLKGNTTGSASIRAGLPKCWVVGDKTGSGDYGTTNDIAVIWPENHAPLVLVTYFTQPEQKAESRRDVLAAAAKIVTHGF

SEQ ID NO: 430 - protein, 291 aa, Unknown
  Resistance Marker For Multiple Organisms
MMTQSIRRSMLTVMATLPLLFSSATLHAQANSVQQQLEALEKSSGGRLGVALINTADNSQILYVADERFAMCSTSKVMAAAAVLKQSESDKHLLNQRVEIRASDLVNYNPIAEKHVNGTMTLAQLGAGALQYSDNTAMNKLIAHLGGPDKVTAFARSLGDETFRLDRTEPTLNSAIPGDPRDTTTPLAMAQTLKNLTLGKALAETQRAQLVTWLKGNTTGSASIRAGLPKSWGVGDKTGSGDYGTTNDIAVIWPENHAPLVLVTYFTQPEQKAESRRDVLAAAAKIVTHGF

SEQ ID NO: 431 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVDGTMSLAELSAAALQYSDNVAMNKLISHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 432 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 433 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTDGL

SEQ ID NO: 434 - protein, 291 aa, Unknown
  Resistance Marker For Multiple Organisms
MMTQSIRRSMLTVMATLPLLFSSATLHAQANSVQQQLEALEKSSGGRLGVAQINTADNSQILYVADERFAMCSTSKVMAAAAVLKQSESDKHLLNQRVEIRASDLVNYNPIAEKHVNGTMTLAELGAGALQYSDNTAMNKLIAHLGGPDKVTAFARSLGDETFRLDRTEPTLNSAIPGDPRDTTTPLAMAQTLKNLTLGKALAETQRAQLVTWLKGNTTGSASIRAGMPKSWGVGDKTGSGDYGTTNDIAVIWPENHAPLVLVTYFTQPEQKAESRRDILAAAAKIVTHGF

SEQ ID NO: 435 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDFLAAAAKIVTHGF

SEQ ID NO: 436 - protein, 291 aa, Unknown
  Resistance Marker For Multiple Organisms
MVTKRVQRMMFAGGAGIPLLLGSAPFYAQTSAGQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 437 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTNGL

SEQ ID NO: 438 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVDGTMSLAELSAAALQYSDNVAMNKLISHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTNGL

SEQ ID NO: 439 - protein, 291 aa, Unknown
  Resistance Marker For Multiple Organisms
MMTQSIRRSMLTVMATLPLLFSSATLHAQANSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDESFRLDRTEPTLNTAIPGDPRDTTTPLAMAQTLKNLTLGKALAETQRAQLVTWLKGNTTGSASIRAGLPKSWVVGDKTGSGDYGTTNDIAVIWPENHAPLVLVTYFTQPEQKAESRRDILAAAAKIVTHGF

SEQ ID NO: 440 - protein, 291 aa, Unknown
  Resistance Marker For Multiple Organisms
MVKKSLRQFTLMATAAVTLLLGSVPLYAQTADVQQKLAELERQSGGRLGVALINTADNSQILYRADERFAMCSTSKVMAAAAVLKKSESEPSLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDILASAAKIVTDGL

SEQ ID NO: 441 - protein, 291 aa, Unknown
  Resistance Marker For Multiple Organisms
MVKKSLRQFTLMATAAVTLLLGSVPLYAQTADVQQKLAELERQSGGRLGVALINTADNSQILYRADERFAMCSTSKVMAVAAVLKKSESEPSLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDILASAAKIVTDGL

SEQ ID NO: 442 - protein, 291 aa, Unknown
  Resistance Marker For Multiple Organisms
MMTQSIRRSMLTVMATLPLLFSSATLHAQTNSVQQQLKALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIQAGLPKSWVVGDKTGSGDYGTTNDIAIIWPENHAPLVLVTYFTQPEQKAESRRDVLAAAAKIVTRGF

SEQ ID NO: 443 - protein, 291 aa, Unknown
  Resistance Marker For Multiple Organisms
MMRKSVRRAILMTTACVSLLLASVPLYAQANDIQQKLAALEKSSGGRLGVALINTADNTQTLYRADERFAMCSTSKVMAAAAVLKQSETQKDLLSQRVEIKSSDLINYNPIAEKHVNGTMTLGELSAAALQYSDNTAMNKLIAHLGGPGKVTAFARVIGDDTFRLDRTEPTLNTAIPGDPRDTTTPLAMAQTLRNLTLGNALGDTQRAQLVTWLKGNTTGAASIQAGLPTSWVVGDKTGSGDYGTTNDIAVIWPEGRAPLVLVTYFTQPEPKAESRRDVLAAAARIVTDGY

SEQ ID NO: 444 - protein, 291 aa, Unknown
  Resistance Marker For Multiple Organisms
MMTQSIRRSMLTVMATLPLLFSSATLHAQTNSVQQQLEALEKSSGGRLGVALINTADNSQILYRADERFAMCSTSKVMAAAAVLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIRAGLPKSWGVGDKTGSGDYGTTNDIAVIWPENHAPLVLVTYFTQPEQKAESRRDVLAAAAKIVTHGF

SEQ ID NO: 445 - protein, 291 aa, Unknown
  Resistance Marker For Multiple Organisms
MMTQSIRRSMLTVMATLPLLFSSATLHAQTNSVQQQLEALEKSSGGRLGVALINTADNSQILYRADERFAMCSTSKVMAAAALLKQSESDKHLLNQRVEIKKSDLVNYNPIAEKHVNGTMTLAELGAAALQYSDNTAMNKLIAHLGGPDKVTAFARSLGDETFRLDRTEPTLNTAIPGDPRDTTTPLAMAQTLKNLTLGKALAETQRAQLVTWLKGNTTGSASIQAGLPKSWVVGDKTGSGDYGTTNDIAVIWPENHAPLVLVTYFTQPEQKAESRRDVLAAAAKIVTHGF

SEQ ID NO: 446 - protein, 5 aa, Unknown
  Resistance Marker For Multiple Organisms
AGLPK

SEQ ID NO: 447 - protein, 12 aa, Unknown
  Resistance Marker For Multiple Organisms
AGLPTSWTVGDK

SEQ ID NO: 448 - protein, 8 aa, Unknown
  Resistance Marker For Multiple Organisms
AIGDETFR

SEQ ID NO: 449 - protein, 7 aa, Unknown
  Resistance Marker For Multiple Organisms
ALAETQR

SEQ ID NO: 450 - protein, 7 aa, Unknown
  Resistance Marker For Multiple Organisms
ALGDSQR

SEQ ID NO: 451 - protein, 7 aa, Unknown
  Resistance Marker For Multiple Organisms
AMAQTLR

SEQ ID NO: 452 - protein, 15 aa, Unknown
  Resistance Marker For Multiple Organisms
APLILVTYFTQPQPK

SEQ ID NO: 453 - protein, 19 aa, Unknown
  Resistance Marker For Multiple Organisms
APLVLVTYFTQPQQNAESR

SEQ ID NO: 454 - protein, 8 aa, Unknown
  Resistance Marker For Multiple Organisms
AQLVTWLK

SEQ ID NO: 455 - protein, 8 aa, Unknown
  Resistance Marker For Multiple Organisms
AQLVTWMK

SEQ ID NO: 456 - protein, 8 aa, Unknown
  Resistance Marker For Multiple Organisms
DILAAAAK

SEQ ID NO: 457 - protein, 6 aa, Unknown
  Resistance Marker For Multiple Organisms
DTTSPR

SEQ ID NO: 458 - protein, 13 aa, Unknown
  Resistance Marker For Multiple Organisms
DTTTPLAMAQTLK

SEQ ID NO: 459 - protein, 6 aa, Unknown
  Resistance Marker For Multiple Organisms
DTTTPR

SEQ ID NO: 460 - protein, 8 aa, Unknown
  Resistance Marker For Multiple Organisms
DVLAAAAK

SEQ ID NO: 461 - protein, 8 aa, Unknown
  Resistance Marker For Multiple Organisms
DVLASAAK

SEQ ID NO: 462 - protein, 8 aa, Unknown
  Resistance Marker For Multiple Organisms
DVLASAAR

SEQ ID NO: 463 - protein, 8 aa, Unknown
  Resistance Marker For Multiple Organisms
FAMCSTSK

SEQ ID NO: 464 - protein, 8 aa, Unknown
  Resistance Marker For Multiple Organisms
FPMCSTSK

SEQ ID NO: 465 - protein, 22 aa, Unknown
  Resistance Marker For Multiple Organisms
GNTTGAASIQAGLPASWVVGDK

SEQ ID NO: 466 - protein, 22 aa, Unknown
  Resistance Marker For Multiple Organisms
GNTTGAASIQAGLPTSWVVGDK

SEQ ID NO: 467 - protein, 10 aa, Unknown
  Resistance Marker For Multiple Organisms
GNTTGAASIR

SEQ ID NO: 468 - protein, 10 aa, Unknown
  Resistance Marker For Multiple Organisms
GNTTGSASIR

SEQ ID NO: 469 - protein, 6 aa, Unknown
  Resistance Marker For Multiple Organisms
HLLNQR

SEQ ID NO: 470 - protein, 6 aa, Unknown
  Resistance Marker For Multiple Organisms
LAALEK

SEQ ID NO: 471 - protein, 6 aa, Unknown
  Resistance Marker For Multiple Organisms
LAELER

SEQ ID NO: 472 - protein, 17 aa, Unknown
  Resistance Marker For Multiple Organisms
LGVALIDTADNTQVLYR

SEQ ID NO: 473 - protein, 17 aa, Unknown
  Resistance Marker For Multiple Organisms
LGVALINTADNSQILYR

SEQ ID NO: 474 - protein, 10 aa, Unknown
  Resistance Marker For Multiple Organisms
LIAHLGGPDK

SEQ ID NO: 475 - protein, 16 aa, Unknown
  Resistance Marker For Multiple Organisms
LIAHVGGPASVTAFAR

SEQ ID NO: 476 - protein, 16 aa, Unknown
  Resistance Marker For Multiple Organisms
LIAQLGGPGGVTAFAR

SEQ ID NO: 477 - protein, 6 aa, Unknown
  Resistance Marker For Multiple Organisms
NLTLGK

SEQ ID NO: 478 - protein, 8 aa, Unknown
  Resistance Marker For Multiple Organisms
QLGDETFR

SEQ ID NO: 479 - protein, 10 aa, Unknown
  Resistance Marker For Multiple Organisms
QLLNQPVEIK

SEQ ID NO: 480 - protein, 13 aa, Unknown
  Resistance Marker For Multiple Organisms
QLTLGHALGETQR

SEQ ID NO: 481 - protein, 6 aa, Unknown
  Resistance Marker For Multiple Organisms
QSESDK

SEQ ID NO: 482 - protein, 6 aa, Unknown
  Resistance Marker For Multiple Organisms
QSETQK

SEQ ID NO: 483 - protein, 5 aa, Unknown
  Resistance Marker For Multiple Organisms
QSGGR

SEQ ID NO: 484 - protein, 12 aa, Unknown
  Resistance Marker For Multiple Organisms
SDLVNYNPIAEK

SEQ ID NO: 485 - protein, 11 aa, Unknown
  Resistance Marker For Multiple Organisms
SESEPNLLNQR

SEQ ID NO: 486 - protein, 8 aa, Unknown
  Resistance Marker For Multiple Organisms
SLGDETFR

SEQ ID NO: 487 - protein, 5 aa, Unknown
  Resistance Marker For Multiple Organisms
SSGGR

SEQ ID NO: 488 - protein, 7 aa, Unknown
  Resistance Marker For Multiple Organisms
SWVVGDK

SEQ ID NO: 489 - protein, 14 aa, Unknown
  Resistance Marker For Multiple Organisms
TEPTLNTAIPGDPR

SEQ ID NO: 490 - protein, 18 aa, Unknown
  Resistance Marker For Multiple Organisms
TGSGDYGTTNDIAVIWPK

SEQ ID NO: 491 - protein, 20 aa, Unknown
  Resistance Marker For Multiple Organisms
TGSGDYGTTNDIAVIWPQGR

SEQ ID NO: 492 - protein, 18 aa, Unknown
  Resistance Marker For Multiple Organisms
TGSGGYGTTNDIAVIWPK

SEQ ID NO: 493 - protein, 9 aa, Unknown
  Resistance Marker For Multiple Organisms
VMAAAAVLK

SEQ ID NO: 494 - protein, 9 aa, Unknown
  Resistance Marker For Multiple Organisms
VMAVAAVLK

SEQ ID NO: 495 - protein, 6 aa, Unknown
  Resistance Marker For Multiple Organisms
VTAFAR

SEQ ID NO: 496 - protein, 286 aa, Unknown
  Resistance Marker For Multiple Organisms
KRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 497 - protein, 286 aa, Unknown
  Resistance Marker For Multiple Organisms
LRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSASSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 498 - protein, 286 aa, Unknown
  Resistance Marker For Multiple Organisms
MRFIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 499 - protein, 286 aa, Unknown
  Resistance Marker For Multiple Organisms
MRFIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNNAERMVVIYLRDTPASMAERNQQIAGIGAALIEHWQR

SEQ ID NO: 500 - protein, 286 aa, Unknown
  Resistance Marker For Multiple Organisms
MRFIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 501 - protein, 285 aa, Unknown
  Resistance Marker For Multiple Organisms
MRIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPVGLTAFLRQIGDNVTRLDRWETELNEALPGDARDTTTPASMAATLRKLLTSQRLSARSQRQLLQWMVDDRVAGPLIRSVLPAGWFIADRTGAGERGARGIVALLGPNNKAERIVVIYLRDTPASMAERNQQIAGIGAALIEHWQR

SEQ ID NO: 502 - protein, 286 aa, Unknown
  Resistance Marker For Multiple Organisms
MRYARLCIISLLATLPLVVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 503 - protein, 286 aa, Unknown
  Resistance Marker For Multiple Organisms
MRYFRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 504 - protein, 286 aa, Unknown
  Resistance Marker For Multiple Organisms
MRYFRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPVGLTAFLRQIGDNVTRLDRWETELNEALPGDARDTTTPASMAATLRKLLTSQRLSARSQRQLLQWMVDDRVAGPLIRSVLPAGWFIADRTGAGERGARGIVALLGPNNKAERIVVIYLRDTPASMAERNQQIAGIGAALIEHWQR

SEQ ID NO: 505 - protein, 286 aa, Unknown
  Resistance Marker For Multiple Organisms
MRYFRLCIISLLATLPLAVHASPQPLEQIKLSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 506 - protein, 286 aa, Unknown
  Resistance Marker For Multiple Organisms
MRYFRLCIISLLATLPLAVHASPQPLEQIKLSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAAKRGARGIVALLGPNNKAERIVVIYLRDTPASMAERNQQIAGIGAALIEHWQR

SEQ ID NO: 507 - protein, 286 aa, Unknown
  Resistance Marker For Multiple Organisms
MRYFRLCIISLLATLPLAVHASPQPLEQIKLSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 508 - protein, 286 aa, Unknown
  Resistance Marker For Multiple Organisms
MRYFRLCIISLLATLPLAVHASPQPLEQIKLSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 509 - protein, 286 aa, Unknown
  Resistance Marker For Multiple Organisms
MRYFRLCIISLLATLPLAVHASPQPLEQIKLSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 510 - protein, 286 aa, Unknown
  Resistance Marker For Multiple Organisms
MRYFRLCIISLLATLPLAVHASPQPLEQIKLSESQLSGSVGMIEMDLASGRTLTAWRADGRFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 511 - protein, 286 aa, Unknown
  Resistance Marker For Multiple Organisms
MRYIRLCIISLLAALPLAVHASPQPLEQIKQSESQLSGRVGMIEMDLASGRTLTAWRADERFPMISTFKVVLCGAVLARVDAGDEQLERKIHYRQQDLVDYSPVSEKHLADGMTVGELCAAAITMSDNSAANLLLAIVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 512 - protein, 286 aa, Unknown
  Resistance Marker For Multiple Organisms
MRYIRLCIISLLAALPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVEDRVAGPLIRSVLPAGWFIADKTGAGERGARGIVALLGPNNKAERIVVIYLRDTPASMAERNQQIAGIGAALIEHWQR

SEQ ID NO: 513 - protein, 286 aa, Unknown
  Resistance Marker For Multiple Organisms
MRYIRLCIISLLAALPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQHIAGIGAALIEHWQR

SEQ ID NO: 514 - protein, 286 aa, Unknown
  Resistance Marker For Multiple Organisms
MRYIRLCIISLLAALPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 515 - protein, 286 aa, Unknown
  Resistance Marker For Multiple Organisms
MRYIRLCIISLLATLPLAVHASPQPLDQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 516 - protein, 286 aa, Unknown
  Resistance Marker For Multiple Organisms
MRYIRLCIISLLATLPLAVHASPQPLEQIKLSESQLSGRVGMIEMDLASGRTLTAWHADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 517 - protein, 286 aa, Unknown
  Resistance Marker For Multiple Organisms
MRYIRLCIISLLATLPLAVHASPQPLEQIKLSESQLSGRVGMIEMDLASGRTLTAWHADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGKRGARGIVALLGPNNKAERIVVIYLRDTPASMAKRNQQIAGIGAALIEHWQR

SEQ ID NO: 518 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMISTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 519 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYLQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 520 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHFADGMTVGELCAAAITMSDNSAANLLLATVGGPAGLSAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 521 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTIGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 522 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGEFCAAAITMSDNSAANLLLATVGGPAGLTAFLRQIGDNVTRLDRWETELNEAFPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 523 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGEFCAAAITMSDNSAANLLLATVGGPAGLTAFLRQIGDNVTRLDRWETELNEALPGDARDTTTPASMAGTLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 524 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAAKLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 525 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATFGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 526 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGLAGLTAFLRQIGDNVTRLDRWETELNEALPADARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 527 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 528 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 529 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDKVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 530 - protein, 291 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 531 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEAFPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 532 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEAFPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 533 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARATTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 534 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLNSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 535 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARLQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 536 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQLQLLQWMVDDRVAGPLIRSVLPAGWFIADKTGAGERGARGIVALLGPNNKAERIVVIYLRDTPASMAERNQQIAGIGAALIEHWQR

SEQ ID NO: 537 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQLQLLQWMVDDRVAGPLIRSVLPAGWFIADKTGASERGARGIVALLGPNNKAERIVVIYLRDTPASMAERNQQIAGIGAALIEHWQR

SEQ ID NO: 538 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQLQLLQWMVDDRVAGPLIRSVLPAGWFIADKTGASKRGARGIVALLGPNNKAERIVVIYLRDTPASMAERNQQIAGIGAALIEHWQR

SEQ ID NO: 539 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDGVAGPLIRSVLPAGWFIADKTGAGERGARGIVALLGPNNKAERIVVIYLRDTPASMAERNQQIAGIGAALIEHWQR

SEQ ID NO: 540 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAAERGARGIVALLGPNNKAERIVVIYLRDTPASMAERNQQIAGIGAALIEHWQR

SEQ ID NO: 541 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPDNKAERIVVIYLRDTPASMAERNQQIAGIGAALIEHWQR

SEQ ID NO: 542 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNHKAERIVVIYLRDTPASMAERNQQIAGIGAALIEHWQR

SEQ ID NO: 543 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 544 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALRGPNNKAERIVVIYLRDTPASMAERNQQIAGIGAALIEHWQR

SEQ ID NO: 545 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGKRGARGIVALLGPNNKAERIVVIYLRDSPASMAERNQQIAGIGAALIEHWQR

SEQ ID NO: 546 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGKRGARGIVALLGPNNKAERTVVIYLRDTPASMAERNQQIAGIGAALIEHWQR

SEQ ID NO: 547 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDSPASMAERNQQIAGIGAALIEHWQR

SEQ ID NO: 548 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 549 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 550 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGLGAALIEHWQR

SEQ ID NO: 551 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADRTGAGERGARGIVALLGPNNKAERIVVIYLRDTPASMAERNQQIAGIGAALIEHWQR

SEQ ID NO: 552 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLSAGWFIADKTGAGERGARGIVALLGPNNKAERIVVIYLRDTPASMAERNQQIAGIGAALIEHWQR

SEQ ID NO: 553 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDGRVAGPLIRSVLPAGWFIADKTGAGERGARGIVALLGPNNKAERIVVIYLRDTPASMAERNQQIAGIGAALIEHWQR

SEQ ID NO: 554 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRHLLQWMVDDRVAGPLIRSVLPAGWFIADKTGAGERGARGIVALLGPNNKAERIVVIYLRDTPASMAERNQQIAGIGAALIEHWQR

SEQ ID NO: 555 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 556 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRQLLQWMVDDRVAGPLIRSVLPAGWFIADKTGAGKRGARGIVALLGPNNKAERIVVIYLRDTPASMAERNQQIAGIGAALIEHWQR

SEQ ID NO: 557 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 558 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARGTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 559 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARNTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 560 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALSGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 561 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETERNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 562 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGENVTRLDRWETELNEALPGDARDTTTPASMAATLRKLLTNQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 563 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPVGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 564 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSVANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTLASMAERNQQIAGIGAALIEHWQR

SEQ ID NO: 565 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAVITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 566 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCTAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 567 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKYLADGMTVGELCAAAITMSDNSAANLLLATVGGPVGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 568 - protein, 285 aa, Unknown
  Resistance Marker For Multiple Organisms
MRYIRLCIISLLATLPLAVHASPQPLEQIKLSESQLSGRVGMIEMDLASRTLTAWRADERFPMMSTFKVVLCGAVLARVDAGDEQLERKIHYRQQDLVDYSPVSEKHLADGMTVGELCAAAITMGDNSAANLLLRTVGGPAGLTAFLRQIGDNVTRLDRWETELNEALPGDARDTTTPASMAATLRNVLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 569 - protein, 285 aa, Unknown
  Resistance Marker For Multiple Organisms
MRYIRLCIISLLATLPLAVHASPQPLEQIKLSESQLSGRVGMIEMDLASRTLTAWRADERFPMMSTFKVVLCGAVLARVDAGDEQLERKIHYRQQDLVDYSPVSEKHLADGMTVGELCAAAITMSDNSAANLLLRTVGGPAGLTAFLRQIGDNVTRLDRWETELNEALPGDARDTTTPASMAATLRNVLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 570 - protein, 286 aa, Unknown
  Resistance Marker For Multiple Organisms
MRYIRLCIISLLATLPLAVHASPQPLEQIKLSESQLSGRVGMIEMDLASSRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 571 - protein, 286 aa, Unknown
  Resistance Marker For Multiple Organisms
MRYIRLCIISLLATLPLAVHASPQPLEQIKQSESQLSGRVGMIEMDLASGRTLTAWCADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 572 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMISTFKVVLCGAVLARVDAGDEQLERKIHYRQQDLVDYSPVSEKHLADGMTVGELCAAAITMSDNSAANLLLAIVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 573 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVALCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 574 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVLLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 575 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAMLARVDAGDKQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 576 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLAIVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 577 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 578 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLISQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 579 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDARVAGPLIRSVLPAGWFIADKTGAGERGARGIVALLGPNNKAERIVVIYLRDTPASMAERNQQIAGIGAALIEHWQR

SEQ ID NO: 580 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKAGAGERGARGIVALLGPNNKAERIVVIYLRDTPASMAERNQQIAGIGAALIEHWQR

SEQ ID NO: 581 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAAERGARGIVALLGPNNKAERIVVIYLRDTPASMAERNQQIAGIGAALIEHWQR

SEQ ID NO: 582 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 583 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGGRGIVALLGPNNKAERIVVIYLRDTPASMAERNQQIAGIGAALIEHWQR

SEQ ID NO: 584 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGKRGARGIVALLGPNNKAERIVVIYLRDTPASMAERNQQIAGIGAALIEHWQR

SEQ ID NO: 585 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASERGARGIVALLGPNNKAERIVVIYLRDTPASMAERNQQIAGIGAALIEHWQR

SEQ ID NO: 586 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGGNIKAERIVVIYLRDTPASMAERNQQIAGIGAALIEHWQR

SEQ ID NO: 587 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAELDQQIAGIGAALIEHWQR

SEQ ID NO: 588 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 589 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASRRGARGIVALLGPNNKAERIVVIYLRDTPASMAERNQQIAGIGAALIEHWQR

SEQ ID NO: 590 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADRTGAGERGARGIVALLGPNNKAERIVVIYLRDTPASMAERNQQIAGIGAALIEHWQR

SEQ ID NO: 591 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 592 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEVLPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 593 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGVTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 594 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPTGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 595 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGSPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 596 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 597 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLTDGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 598 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKYLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 599 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQHLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 600 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDKQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGGRGIVALLGPNNKAERIVVIYLRDTPASMAERNQQIAGIGAALIEHWQR

SEQ ID NO: 601 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGTVLARVDAGDEQLERKIHYRQQDLVDYSPVSEKHLADGMTVGELCAAAITMSDNSAANLLLATVGGPAGLTAFLRQIDDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 602 - protein, 286 aa, Unknown
  Resistance Marker For Multiple Organisms
MRYIRLCIISLLATLPLAVHASPQPLEQIKQSESQLSGRVGMIEMDLASGRTLTAWRADQRFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 603 - protein, 286 aa, Unknown
  Resistance Marker For Multiple Organisms
MRYIRLCIISLLATLPLAVHASPQPLEQIKQSESQLSGSVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAAERGARGIVALLGPNNKAERIVVIYLRDTPASMAERNQQIAGIGAALIEHWQR

SEQ ID NO: 604 - protein, 286 aa, Unknown
  Resistance Marker For Multiple Organisms
MRYIRLCIISLLATLPLAVHSSPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 605 - protein, 286 aa, Unknown
  Resistance Marker For Multiple Organisms
MRYIRLCIISLLATLPLTVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 606 - protein, 286 aa, Unknown
  Resistance Marker For Multiple Organisms
MRYIRLCIISLLATLSLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGKRGARGIVALLGPNNKAERIVVIYLRDTPASMAERNQQIAGIGAALIEHWQR

SEQ ID NO: 607 - protein, 286 aa, Unknown
  Resistance Marker For Multiple Organisms
MRYIRLCIISLLATMPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 608 - protein, 286 aa, Unknown
  Resistance Marker For Multiple Organisms
MRYIRLCIISLLAVLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 609 - protein, 286 aa, Unknown
  Resistance Marker For Multiple Organisms
MRYIRLNIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 610 - protein, 286 aa, Unknown
  Resistance Marker For Multiple Organisms
MRYIRRCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDMPASMAERNQQIAGIGAALIEHWQR

SEQ ID NO: 611 - protein, 286 aa, Unknown
  Resistance Marker For Multiple Organisms
MRYIRRCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 612 - protein, 286 aa, Unknown
  Resistance Marker For Multiple Organisms
MRYVRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 613 - protein, 286 aa, Unknown
  Resistance Marker For Multiple Organisms
MRYVRLCIISLLATLPLAVHTSPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 614 - protein, 6 aa, Unknown
  Resistance Marker For Multiple Organisms
AGAGER

SEQ ID NO: 615 - protein, 13 aa, Unknown
  Resistance Marker For Multiple Organisms
ATTTPASMAATLR

SEQ ID NO: 616 - protein, 24 aa, Unknown
  Resistance Marker For Multiple Organisms
CIISLLATLPLAVHASPQPLEQIK

SEQ ID NO: 617 - protein, 9 aa, Unknown
  Resistance Marker For Multiple Organisms
DMPASMAER

SEQ ID NO: 618 - protein, 9 aa, Unknown
  Resistance Marker For Multiple Organisms
DSPASMAER

SEQ ID NO: 619 - protein, 9 aa, Unknown
  Resistance Marker For Multiple Organisms
DTLASMAER

SEQ ID NO: 620 - protein, 9 aa, Unknown
  Resistance Marker For Multiple Organisms
DTPASMAER

SEQ ID NO: 621 - protein, 8 aa, Unknown
  Resistance Marker For Multiple Organisms
DTPASMAK

SEQ ID NO: 622 - protein, 13 aa, Unknown
  Resistance Marker For Multiple Organisms
DTTTPASMAATLR

SEQ ID NO: 623 - protein, 13 aa, Unknown
  Resistance Marker For Multiple Organisms
DTTTPASMAGTLR

SEQ ID NO: 624 - protein, 13 aa, Unknown
  Resistance Marker For Multiple Organisms
DTTTPASMTATLR

SEQ ID NO: 625 - protein, 8 aa, Unknown
  Resistance Marker For Multiple Organisms
FPMISTFK

SEQ ID NO: 626 - protein, 8 aa, Unknown
  Resistance Marker For Multiple Organisms
FPMMSTFK

SEQ ID NO: 627 - protein, 11 aa, Unknown
  Resistance Marker For Multiple Organisms
GIVALLGGNIK

SEQ ID NO: 628 - protein, 11 aa, Unknown
  Resistance Marker For Multiple Organisms
GIVALLGPDNK

SEQ ID NO: 629 - protein, 11 aa, Unknown
  Resistance Marker For Multiple Organisms
GIVALLGPNHK

SEQ ID NO: 630 - protein, 11 aa, Unknown
  Resistance Marker For Multiple Organisms
GIVALLGPNNK

SEQ ID NO: 631 - protein, 14 aa, Unknown
  Resistance Marker For Multiple Organisms
GIVALLGPNNNAER

SEQ ID NO: 632 - protein, 6 aa, Unknown
  Resistance Marker For Multiple Organisms
GIVALR

SEQ ID NO: 633 - protein, 5 aa, Unknown
  Resistance Marker For Multiple Organisms
GPNNK

SEQ ID NO: 634 - protein, 13 aa, Unknown
  Resistance Marker For Multiple Organisms
GTTTPASMAATLR

SEQ ID NO: 635 - protein, 25 aa, Unknown
  Resistance Marker For Multiple Organisms
HLADGMTVGELCAAAITMSDNSAAK

SEQ ID NO: 636 - protein, 10 aa, Unknown
  Resistance Marker For Multiple Organisms
HLLQWMVDDR

SEQ ID NO: 637 - protein, 17 aa, Unknown
  Resistance Marker For Multiple Organisms
IHYLQQDLVDYSPVSEK

SEQ ID NO: 638 - protein, 7 aa, Unknown
  Resistance Marker For Multiple Organisms
IVVIYLR

SEQ ID NO: 639 - protein, 25 aa, Unknown
  Resistance Marker For Multiple Organisms
LCIISLLAALPLAVHASPQPLEQIK

SEQ ID NO: 640 - protein, 25 aa, Unknown
  Resistance Marker For Multiple Organisms
LCIISLLATLPLAVHASPQPLDQIK

SEQ ID NO: 641 - protein, 25 aa, Unknown
  Resistance Marker For Multiple Organisms
LCIISLLATLPLAVHASPQPLEQIK

SEQ ID NO: 642 - protein, 25 aa, Unknown
  Resistance Marker For Multiple Organisms
LCIISLLATLPLAVHSSPQPLEQIK

SEQ ID NO: 643 - protein, 25 aa, Unknown
  Resistance Marker For Multiple Organisms
LCIISLLATLPLAVHTSPQPLEQIK

SEQ ID NO: 644 - protein, 25 aa, Unknown
  Resistance Marker For Multiple Organisms
LCIISLLATLPLTVHASPQPLEQIK

SEQ ID NO: 645 - protein, 25 aa, Unknown
  Resistance Marker For Multiple Organisms
LCIISLLATLPLVVHASPQPLEQIK

SEQ ID NO: 646 - protein, 25 aa, Unknown
  Resistance Marker For Multiple Organisms
LCIISLLATLSLAVHASPQPLEQIK

SEQ ID NO: 647 - protein, 25 aa, Unknown
  Resistance Marker For Multiple Organisms
LCIISLLATMPLAVHASPQPLEQIK

SEQ ID NO: 648 - protein, 25 aa, Unknown
  Resistance Marker For Multiple Organisms
LCIISLLAVLPLAVHASPQPLEQIK

SEQ ID NO: 649 - protein, 6 aa, Unknown
  Resistance Marker For Multiple Organisms
LLISQR

SEQ ID NO: 650 - protein, 17 aa, Unknown
  Resistance Marker For Multiple Organisms
LLLATVGGPAGLTAFLR

SEQ ID NO: 651 - protein, 6 aa, Unknown
  Resistance Marker For Multiple Organisms
LLNSQR

SEQ ID NO: 652 - protein, 6 aa, Unknown
  Resistance Marker For Multiple Organisms
LLTNQR

SEQ ID NO: 653 - protein, 6 aa, Unknown
  Resistance Marker For Multiple Organisms
LLTSQR

SEQ ID NO: 654 - protein, 25 aa, Unknown
  Resistance Marker For Multiple Organisms
LNIISLLATLPLAVHASPQPLEQIK

SEQ ID NO: 655 - protein, 7 aa, Unknown
  Resistance Marker For Multiple Organisms
LSASSQR

SEQ ID NO: 656 - protein, 9 aa, Unknown
  Resistance Marker For Multiple Organisms
LSESQLSGR

SEQ ID NO: 657 - protein, 21 aa, Unknown
  Resistance Marker For Multiple Organisms
LSESQLSGSVGMIEMDLASGR

SEQ ID NO: 658 - protein, 7 aa, Unknown
  Resistance Marker For Multiple Organisms
MVVIYLR

SEQ ID NO: 659 - protein, 9 aa, Unknown
  Resistance Marker For Multiple Organisms
NEALPGDAR

SEQ ID NO: 660 - protein, 17 aa, Unknown
  Resistance Marker For Multiple Organisms
NQHIAGIGAALIEHWQR

SEQ ID NO: 661 - protein, 17 aa, Unknown
  Resistance Marker For Multiple Organisms
NQQIAGIGAALIEHWQR

SEQ ID NO: 662 - protein, 17 aa, Unknown
  Resistance Marker For Multiple Organisms
NQQIAGLGAALIEHWQR

SEQ ID NO: 663 - protein, 13 aa, Unknown
  Resistance Marker For Multiple Organisms
NTTTPASMAATLR

SEQ ID NO: 664 - protein, 7 aa, Unknown
  Resistance Marker For Multiple Organisms
NVLTSQR

SEQ ID NO: 665 - protein, 8 aa, Unknown
  Resistance Marker For Multiple Organisms
QIDDNVTR

SEQ ID NO: 666 - protein, 5 aa, Unknown
  Resistance Marker For Multiple Organisms
QIGDK

SEQ ID NO: 667 - protein, 8 aa, Unknown
  Resistance Marker For Multiple Organisms
QIGDNVTR

SEQ ID NO: 668 - protein, 8 aa, Unknown
  Resistance Marker For Multiple Organisms
QIGENVTR

SEQ ID NO: 669 - protein, 10 aa, Unknown
  Resistance Marker For Multiple Organisms
QLLQWMVDAR

SEQ ID NO: 670 - protein, 17 aa, Unknown
  Resistance Marker For Multiple Organisms
QLLQWMVDDGVAGPLIR

SEQ ID NO: 671 - protein, 10 aa, Unknown
  Resistance Marker For Multiple Organisms
QLLQWMVDDR

SEQ ID NO: 672 - protein, 10 aa, Unknown
  Resistance Marker For Multiple Organisms
QLLQWMVDGR

SEQ ID NO: 673 - protein, 10 aa, Unknown
  Resistance Marker For Multiple Organisms
QLLQWMVEDR

SEQ ID NO: 674 - protein, 13 aa, Unknown
  Resistance Marker For Multiple Organisms
QQDLVDYSPVSEK

SEQ ID NO: 675 - protein, 13 aa, Unknown
  Resistance Marker For Multiple Organisms
QQHLVDYSPVSEK

SEQ ID NO: 676 - protein, 9 aa, Unknown
  Resistance Marker For Multiple Organisms
QSESQLSGR

SEQ ID NO: 677 - protein, 21 aa, Unknown
  Resistance Marker For Multiple Organisms
QSESQLSGSVGMIEMDLASGR

SEQ ID NO: 678 - protein, 13 aa, Unknown
  Resistance Marker For Multiple Organisms
SQLQLLQWMVDDR

SEQ ID NO: 679 - protein, 12 aa, Unknown
  Resistance Marker For Multiple Organisms
SVLPAGWFIADK

SEQ ID NO: 680 - protein, 12 aa, Unknown
  Resistance Marker For Multiple Organisms
SVLPAGWFIADR

SEQ ID NO: 681 - protein, 12 aa, Unknown
  Resistance Marker For Multiple Organisms
SVLSAGWFIADK

SEQ ID NO: 682 - protein, 6 aa, Unknown
  Resistance Marker For Multiple Organisms
TGAAER

SEQ ID NO: 683 - protein, 5 aa, Unknown
  Resistance Marker For Multiple Organisms
TGAAK

SEQ ID NO: 684 - protein, 6 aa, Unknown
  Resistance Marker For Multiple Organisms
TGAGER

SEQ ID NO: 685 - protein, 5 aa, Unknown
  Resistance Marker For Multiple Organisms
TGAGK

SEQ ID NO: 686 - protein, 6 aa, Unknown
  Resistance Marker For Multiple Organisms
TGASER

SEQ ID NO: 687 - protein, 5 aa, Unknown
  Resistance Marker For Multiple Organisms
TGASK

SEQ ID NO: 688 - protein, 5 aa, Unknown
  Resistance Marker For Multiple Organisms
TGASR

SEQ ID NO: 689 - protein, 10 aa, Unknown
  Resistance Marker For Multiple Organisms
TLTAWCADER

SEQ ID NO: 690 - protein, 10 aa, Unknown
  Resistance Marker For Multiple Organisms
TLTAWHADER

SEQ ID NO: 691 - protein, 6 aa, Unknown
  Resistance Marker For Multiple Organisms
TLTAWR

SEQ ID NO: 692 - protein, 13 aa, Unknown
  Resistance Marker For Multiple Organisms
TVGGPAGLTAFLR

SEQ ID NO: 693 - protein, 7 aa, Unknown
  Resistance Marker For Multiple Organisms
TVVIYLR

SEQ ID NO: 694 - protein, 7 aa, Unknown
  Resistance Marker For Multiple Organisms
VAGPLIR

SEQ ID NO: 695 - protein, 10 aa, Unknown
  Resistance Marker For Multiple Organisms
VALCGAVLAR

SEQ ID NO: 696 - protein, 10 aa, Unknown
  Resistance Marker For Multiple Organisms
VDAGDEQLER

SEQ ID NO: 697 - protein, 6 aa, Unknown
  Resistance Marker For Multiple Organisms
VDAGDK

SEQ ID NO: 698 - protein, 12 aa, Unknown
  Resistance Marker For Multiple Organisms
VGMIEMDLASGR

SEQ ID NO: 699 - protein, 11 aa, Unknown
  Resistance Marker For Multiple Organisms
VGMIEMDLASR

SEQ ID NO: 700 - protein, 12 aa, Unknown
  Resistance Marker For Multiple Organisms
VGMIEMDLASSR

SEQ ID NO: 701 - protein, 10 aa, Unknown
  Resistance Marker For Multiple Organisms
VLLCGAVLAR

SEQ ID NO: 702 - protein, 10 aa, Unknown
  Resistance Marker For Multiple Organisms
VVLCGAMLAR

SEQ ID NO: 703 - protein, 10 aa, Unknown
  Resistance Marker For Multiple Organisms
VVLCGAVLAR

SEQ ID NO: 704 - protein, 10 aa, Unknown
  Resistance Marker For Multiple Organisms
VVLCGTVLAR

SEQ ID NO: 705 - protein, 5 aa, Unknown
  Resistance Marker For Multiple Organisms
WETDR

SEQ ID NO: 706 - protein, 14 aa, Unknown
  Resistance Marker For Multiple Organisms
WETELNEAFPGDAR

SEQ ID NO: 707 - protein, 14 aa, Unknown
  Resistance Marker For Multiple Organisms
WETELNEALPADAR

SEQ ID NO: 708 - protein, 14 aa, Unknown
  Resistance Marker For Multiple Organisms
WETELNEALPGDAR

SEQ ID NO: 709 - protein, 14 aa, Unknown
  Resistance Marker For Multiple Organisms
WETELNEALSGDAR

SEQ ID NO: 710 - protein, 14 aa, Unknown
  Resistance Marker For Multiple Organisms
WETELNEVLPGDAR

SEQ ID NO: 711 - protein, 5 aa, Unknown
  Resistance Marker For Multiple Organisms
WETER

SEQ ID NO: 712 - protein, 382 aa, Unknown
  Resistance Marker For Multiple Organisms
MQQRRAFALLTLGSLLLAPCTYASGEAPLTAAVDGIIQPMLKAYRIPGMAVAVLKDGKAHYFNYGVANRESGQRVSEQTLFEIGSVSKTLTATLGAYAAVKGGFELDDKVSQHAPWLKGSALDGVTMAELATYSAGGLPLQFPDEVDSNDKMRTYYRSWSPVYPAGTHRQYSNPSIGLFGHLAANSLGQPFEQLMSQTLLPKLGLHHTYIQVPESAMVNYAYGYSKEDKPVRVTPGVLAAEAYGIKTGSADLLKFAEANMGYQGDAAVKSAIALTHTGFYSVGDMTQGLGWESYAYPVTEQTLLAGNAPAVSFQANPVTRFAVPKAMGEQRLYNKTGSTGGFGAYVAFVPARGIAIVMLANRNYPIEARVKAAHAILSQLAE

SEQ ID NO: 713 - protein, 382 aa, Unknown; identical to SEQ ID NO: 712
  Resistance Marker For Multiple Organisms

SEQ ID NO: 714 - protein, 382 aa, Unknown
  Resistance Marker For Multiple Organisms
MQQRRAFALLTLGSLLLAPCTYARGEAPLTAAVDGIIQPMLKEYRIPGMAVAVLKDGKAHYFNYGVANRESGQRVSEQTLFEIGSVSKTLTATLGAYAAVKGGFELDDKVSQHAPWLKGSAFDGVTMAELATYSAGGLPLQFPDEVDSNDKMRTYYRHWSPVYPAGTHRQYSNPSIGLFGHLAANSLGQPFEQLMSQTLLPKLGLHHTYIQVPESAIANYAYGYSKEDKPVRVTPGVLAAEAYGIKTGSADLLKFTEANMGYQGDAALKTRIALTHTGFYSVGDMTQGLGWESYAYPLTEQALLAGNSPAVSFQANPVTRFAVPKAMGEQRLYNKTGSTGGFGAYVAFVPARGIAIVMLANRNYPIEARVKAAHAILSQLAE

SEQ ID NO: 715 - protein, 382 aa, Unknown
  Resistance Marker For Multiple Organisms
MQQRRALALLTLGSLLLAPCTYASGEAPLTAAVDGIIQPMLKEYRIPGMAVAVLKDGKAHYFNYGVANRESGQRVSEQTLFEIGSVSKTLTATLGAYAAVKGGFELDDKVSHHAPWLKGSAFDGVTMAELATYSAGGLPLQFPDEVDSNDKMQTYYRSWSPVYPAGTHRQYSNPSIGLFGHLAANSLGQPFEKLMSQTLLPKLGLHHTYIQVPESAMANYAYGYSKEDKPIRVTPGVLAAEAYGIKTGSADLLKFVEANMGYQGDAALKSAIALTHTGFYSVGDMTQGLGWESYAYPVTEQALLAGNSPAVSFQANPVTRFAVPKAMGEQRLYNKTGSTGGFGAYVAFVPARGIAIVMLANRNYPIEARVKAAHAILSQLAE

SEQ ID NO: 716 - protein, 382 aa, Unknown
  Resistance Marker For Multiple Organisms
MQQRRAFALLTLGSLLLAPCTYASGEAPLTATVDGIIQPMLKEYRIPGIAVAVLKDGKAHYFNYGVANRESGQRVSEQTLFEIGSVSKTLTATLGAYAAVKGGFVLDDKVSQHAPWLKGSALDGVTMAELATYSAGGLPLQFPDKVDSNDKMQTYYRSWSPVYPAGTHRQYSNPSIGLFGHLAANSLGQPFEQLMSQTLLPKLGLHHTYIQVPESAMANYAYGYSKEDKPIRVTPGVLAAEAYGIKTGSADLLKFAEANMGYQGDALVKSAIALTHTGFYSVGEMTQGLGWESYDYPVTEQVLLAGNSPAVSFQANPVTRFAVPKAMGEQRLYNKTGSTGGFGAYVAFVPARGIAIVMLANRNYPIEARVKAAHAILSQLAE

SEQ ID NO: 717 - protein, 382 aa, Unknown
  Resistance Marker For Multiple Organisms
MQQRRALALLMLGSLLLAPCTYASGEAPLTATVDGIIQPMLKAYRIPGMAVAVLKDGKAHYFNYGVANRESGQRVSEQTLFEIGSVSKTLTATLGAYAAVKGGFELDDKVSQHAPWLKGSAFDGVTMAELATYSAGGLPLQFPDEVDSNDKMQTYYRSWSPVYPAGTHRQYSNPSIGLFGHLAANSLGQPFEQLMSQTLLPKLGLHHTYIQVPESAMANYAYGYSKEDKPIRATPGVLAAEAYGIKTGSADLLKFVEANMGYQGDAALKSAIALTHTGFHSVGEMTQGLGWESYDYPVTEQVLLAGNSPAVSFQANPVTRFAVPKAMGEQRLYNKTGSTGGFGAYVAFVPARGIAIVMLANRNYPIEARVKAAHAILSQLAE

SEQ ID NO: 718 - protein, 382 aa, Unknown
  Resistance Marker For Multiple Organisms
MQQRRAFALLTLGSLLLAPCTYARGEAPLTAAVDGIIQPMLKEYRIPGMAVAVLKDGKAHYFNYGVANRESGQRVSEQTLFEIGSVSKTLTATLGAYAAVKGGFELDDKVSQHAPWLKGSAFDGVTMAELATYSAGGLPLQFPDEVDSNDKMRTYYRHWSPVYPAGTHRQYSNPSIGLFGHLAANSLGQPFEQLMSQTLLPKLGLHHTYIQVPESAIANYAYGYSKEDKPVRATPGVLAAEAYGIKTGSADLLKFTEANMGYQGDAALKSAIALTHTGFYSVGDMTQGLGWESYAYPLTEQALLAGNSPAVSFQANPVTRFAVPKAMGEQRLYNKTGSTGGFGAYVAFVPARGIAIVMLANRNYPIEARVKAAHAILSQLAE

SEQ ID NO: 719 - protein, 11 aa, Unknown
  Resistance Marker For Multiple Organisms
AHYFNYGVANR

SEQ ID NO: 720 - protein, 6 aa, Unknown
  Resistance Marker For Multiple Organisms
AMGEQR

SEQ ID NO: 721 - protein, 5 aa, Unknown
  Resistance Marker For Multiple Organisms
ESGQR

SEQ ID NO: 722 - protein, 5 aa, Unknown
  Resistance Marker For Multiple Organisms
FAVPK

SEQ ID NO: 723 - protein, 8 aa, Unknown
  Resistance Marker For Multiple Organisms
GGFELDDK

SEQ ID NO: 724 - protein, 10 aa, Unknown
  Resistance Marker For Multiple Organisms
GIAIVMLANR

SEQ ID NO: 725 - protein, 10 aa, Unknown
  Resistance Marker For Multiple Organisms
IPGMAVAVLK

SEQ ID NO: 726 - protein, 7 aa, Unknown
  Resistance Marker For Multiple Organisms
NYPIEAR

SEQ ID NO: 727 - protein, 12 aa, Unknown
  Resistance Marker For Multiple Organisms
SWSPVYPAGTHR

SEQ ID NO: 728 - protein, 8 aa, Unknown
  Resistance Marker For Multiple Organisms
TGSADLLK

SEQ ID NO: 729 - protein, 17 aa, Unknown
  Resistance Marker For Multiple Organisms
TGSTGGFGAYVAFVPAR

SEQ ID NO: 730 - protein, 13 aa, Unknown
  Resistance Marker For Multiple Organisms
TLTATLGAYAAVK

SEQ ID NO: 731 - protein, 14 aa, Unknown
  Resistance Marker For Multiple Organisms
VSEQTLFEIGSVSK

SEQ ID NO: 732 - protein, 9 aa, Unknown
  Resistance Marker For Multiple Organisms
VSQHAPWLK

SEQ ID NO: 733 - protein, 14 aa, Unknown
  Resistance Marker For Multiple Organisms
VTPGVLAAEAYGIK

SEQ ID NO: 734 - protein, 12 aa, Unknown
  Resistance Marker For Multiple Organisms
PSGMSYEEAMTR

SEQ ID NO: 735 - protein, 8 aa, Unknown
  Resistance Marker For Multiple Organisms
PYYFTWGK

SEQ ID NO: 736 - protein, 390 aa, Unknown
  Resistance Marker For Multiple Organisms
MRKKMQNTLKLLSVITCLAATAQGAMAANIDESKIKDTVDGLIQPLMQKNNIPGMSVAVTIRGRNYIYNYGLAAKQPQQPVTENTLFEVGSLSKTFAAILASYAQASGKLSLEQSVSHYVPELRGSSFDHVSVLNVGTHTSGLQLFMPEDIKNTTQLMTYLKAWKPADAAGTHRVYSNIGTGLLGMIAAKSLGVSYEDAIEQTILPLLGMNQTYLKVPADQMENYAWGYNKKDEPVHVNMEILGNEAYGIKTTSSDLLRYVQANMGQLKLDGNAKIQHALTATHTGYFKSGEITQDLMWEQLPYPVSLPNLLTGNDMAMTKSVATPIVPPLPPQENVWINKTGSTNGFGAYIAFVPAKKMGIVMLANKNYSIDQRVTVAYKILSSLEVNK

SEQ ID NO: 737 - protein, 377 aa, Unknown
  Resistance Marker For Multiple Organisms
MRKKMQNTLKMLSVITCLALTAQGAMASEMDQAKIKDTVDSLIQPLMQKNNIPGMSVAVTLNGKNYIYNYGLASKQPQQPVTDNTLFEVGSLSKTFAATLASYAQVSGKLSLDKSISHYVPELRGSSFDHISVLNAGTHTTGLALFMPEEVKNTDQLMAYLKAWKPADPAGTHRVYSNIGTGLLGMIAAQSMGMTYEDAIEKTLLPKLGMTHTYLNVPADQAENYAWGYNKKNEPIHVNMEVLGNEAYGIRTNASDLIRYVQANMGQLKLDGNSTLQKALTDTHIGYFKSGKITQDLMWEQLPYPVSLPDLLTGNDMAMTKSVATPIVPPLPPQENVWINKTGSTNGFGAYIAFVPAKKMGIVMLANKNYSIDQRVT

SEQ ID NO: 738 - protein, 386 aa, Unknown
  Resistance Marker For Multiple Organisms
MQNTLKLLSVITCLAATVQGALAANIDESKIKDTVDDLIQPLMQKNNIPGMSVAVTVNGKNYIYNYGLAAKQPQQPVTENTLFEVGSLSKTFAATLASYAQVSGKLSLDQSVSHYVPELRGSSFDHVSVLNVGTHTSGLQLFMPEDIKNTTQLMAYLKAWKPADAAGTHRVYSNIGTGLLGMIAAKSLGVSYEDAIEKTLLPQLGMHHSYLKVPADQMENYAWGYNKKDEPVHGNMEILGNEAYGIKTTSSDLLRYVQANMGQLKLDANAKMQQALTATHTGYFKSGEITQDLMWEQLPYPVSLPNLLTGNDMAMTKSVATPIVPPLPPQENVWINKTGSTNGFGAYIAFVPAKKMGIVMLANKNYSIDQRVTVAYKILSSLEGNK

SEQ ID NO: 739 - protein, 386 aa, Unknown
  Resistance Marker For Multiple Organisms
MQNTLKLLSVITCLAATVQGALAANIDESKIKDTVDDLIQPLMQKNNIPGMSVAVTVNGKNYIYNYGLAAKQPQQPVTENTLFEVGSLSKTFAATLASYAQVSGKLSLDQSVSHYVPELRGSSFDHVSVLNVGTHTSGLQLFMPEDIKNTTQLMAYLKAWKPADAAGTHRVYSNIGTGLLGMIAAKSLGVSYEDAIEKTLLPQLGMHHSYLKVPADQMENYAWGYNKKDEPVHVNMEILGNEAYGIKTTSSDLLRYVQANMGQLKLDANAKMQQALTATHTGYFKSGEITQDLMWEQLPYPVSLPNLLTGNDMAMTKSVATPIVPPLPPQENVWINKTGSTNGFGAYIAFVPAKKMGIVMLANKNYSIDQRVTVAYKILSSLEGNK

SEQ ID NO: 740 - protein, 11 aa, Unknown
  Resistance Marker For Multiple Organisms
ALTDTHIGYFK

SEQ ID NO: 741 - protein, 12 aa, Unknown
  Resistance Marker For Multiple Organisms
AWKPADAAGTHR

SEQ ID NO: 742 - protein, 12 aa, Unknown
  Resistance Marker For Multiple Organisms
AWKPADPAGTHR

SEQ ID NO: 743 - protein, 19 aa, Unknown
  Resistance Marker For Multiple Organisms
DEPVHGNMEILGNEAYGIK

SEQ ID NO: 744 - protein, 19 aa, Unknown
  Resistance Marker For Multiple Organisms
DEPVHVNMEILGNEAYGIK

SEQ ID NO: 745 - protein, 13 aa, Unknown
  Resistance Marker For Multiple Organisms
DTVDDLIQPLMQK

SEQ ID NO: 746 - protein, 13 aa, Unknown
  Resistance Marker For Multiple Organisms
DTVDGLIQPLMQK

SEQ ID NO: 747 - protein, 13 aa, Unknown
  Resistance Marker For Multiple Organisms
DTVDSLIQPLMQK

SEQ ID NO: 748 - protein, 14 aa, Unknown
  Resistance Marker For Multiple Organisms
IQHALTATHTGYFK

SEQ ID NO: 749 - protein, 6 aa, Unknown
  Resistance Marker For Multiple Organisms
LDANAK

SEQ ID NO: 750 - protein, 6 aa, Unknown
  Resistance Marker For Multiple Organisms
LDGNAK

SEQ ID NO: 751 - protein, 9 aa, Unknown
  Resistance Marker For Multiple Organisms
LDGNSTLQK

SEQ ID NO: 752 - protein, 24 aa, Unknown
  Resistance Marker For Multiple Organisms
LGMTHTYLNVPADQAENYAWGYNK

SEQ ID NO: 753 - protein, 24 aa, Unknown
  Resistance Marker For Multiple Organisms
LLSVITCLAATAQGAMAANIDESK

SEQ ID NO: 754 - protein, 24 aa, Unknown
  Resistance Marker For Multiple Organisms
LLSVITCLAATVQGALAANIDESK

SEQ ID NO: 755 - protein, 5 aa, Unknown
  Resistance Marker For Multiple Organisms
LSLDK

SEQ ID NO: 756 - protein, 15 aa, Unknown
  Resistance Marker For Multiple Organisms
LSLDQSVSHYVPELR

SEQ ID NO: 757 - protein, 15 aa, Unknown
  Resistance Marker For Multiple Organisms
LSLEQSVSHYVPELR

SEQ ID NO: 758 - protein, 9 aa, Unknown
  Resistance Marker For Multiple Organisms
MGIVMLANK

SEQ ID NO: 759 - protein, 24 aa, Unknown
  Resistance Marker For Multiple Organisms
MLSVITCLALTAQGAMASEMDQAK

SEQ ID NO: 760 - protein, 6 aa, Unknown
  Resistance Marker For Multiple Organisms
MQNTLK

SEQ ID NO: 761 - protein, 14 aa, Unknown
  Resistance Marker For Multiple Organisms
MQQALTATHTGYFK

SEQ ID NO: 762 - protein, 19 aa, Unknown
  Resistance Marker For Multiple Organisms
NEPIHVNMEVLGNEAYGIR

SEQ ID NO: 763 - protein, 13 aa, Unknown
  Resistance Marker For Multiple Organisms
NNIPGMSVAVTIR

SEQ ID NO: 764 - protein, 15 aa, Unknown
  Resistance Marker For Multiple Organisms
NNIPGMSVAVTLNGK

SEQ ID NO: 765 - protein, 15 aa, Unknown
  Resistance Marker For Multiple Organisms
NNIPGMSVAVTVNGK

SEQ ID NO: 766 - protein, 10 aa, Unknown
  Resistance Marker For Multiple Organisms
NTDQLMAYLK

SEQ ID NO: 767 - protein, 10 aa, Unknown
  Resistance Marker For Multiple Organisms
NTTQLMAYLK

SEQ ID NO: 768 - protein, 10 aa, Unknown
  Resistance Marker For Multiple Organisms
NTTQLMTYLK

SEQ ID NO: 769 - protein, 11 aa, Unknown
  Resistance Marker For Multiple Organisms
NYIYNYGLAAK

SEQ ID NO: 770 - protein, 11 aa, Unknown
  Resistance Marker For Multiple Organisms
NYIYNYGLASK

SEQ ID NO: 771 - protein, 7 aa, Unknown
  Resistance Marker For Multiple Organisms
NYSIDQR

SEQ ID NO: 772 - protein, 19 aa, Unknown
  Resistance Marker For Multiple Organisms
QPQQPVTDNTLFEVGSLSK

SEQ ID NO: 773 - protein, 19 aa, Unknown
  Resistance Marker For Multiple Organisms
QPQQPVTENTLFEVGSLSK

SEQ ID NO: 774 - protein, 10 aa, Unknown
  Resistance Marker For Multiple Organisms
SISHYVPELR

SEQ ID NO: 775 - protein, 12 aa, Unknown
  Resistance Marker For Multiple Organisms
SLGVSYEDAIEK

SEQ ID NO: 776 - protein, 20 aa, Unknown
  Resistance Marker For Multiple Organisms
SVATPIVPPLPPQENVWINK

SEQ ID NO: 777 - protein, 15 aa, Unknown
  Resistance Marker For Multiple Organisms
TFAAILASYAQASGK

SEQ ID NO: 778 - protein, 15 aa, Unknown
  Resistance Marker For Multiple Organisms
TFAATLASYAQVSGK

SEQ ID NO: 779 - protein, 17 aa, Unknown
  Resistance Marker For Multiple Organisms
TGSTNGFGAYIAFVPAK

SEQ ID NO: 780 - protein, 5 aa, Unknown
  Resistance Marker For Multiple Organisms
TLLPK

SEQ ID NO: 781 - protein, 14 aa, Unknown
  Resistance Marker For Multiple Organisms
TLLPQLGMHHSYLK

SEQ ID NO: 782 - protein, 8 aa, Unknown
  Resistance Marker For Multiple Organisms
TNASDLIR

SEQ ID NO: 783 - protein, 8 aa, Unknown
  Resistance Marker For Multiple Organisms
TTSSDLLR

SEQ ID NO: 784 - protein, 15 aa, Unknown
  Resistance Marker For Multiple Organisms
VPADQMENYAWGYNK

SEQ ID NO: 785 - protein, 6 aa, Unknown
  Resistance Marker For Multiple Organisms
VTVAYK

SEQ ID NO: 786 - protein, 16 aa, Unknown
  Resistance Marker For Multiple Organisms
VYSNIGTGLLGMIAAK

SEQ ID NO: 787 - protein, 10 aa, Unknown
  Resistance Marker For Multiple Organisms
YVQANMGQLK

SEQ ID NO: 788 - protein, 381 aa, Unknown
  Resistance Marker For Multiple Organisms
MMMTKSLCCALLLSTSCSVLATPMSEKQLAEVVERTVTPLMKAQAIPGMAVAVIYEGQPHYFTFGKADVAANKPVTPQTLFELGSISKTFTGVLGGDAIARGEISLGDPVTKYWPELTGKQWQGIRMLDLATYTAGGLPLQVPDEVKDNASLLRFYQNWQPQWKPGTTRLYANASIGLFGALAVKPSGMSYEQAITTRVFKPLKLDHTWINVPKAEEAHYAWGYRDGKAVHVSPGMLDAEAYGVKTNVQDMASWVMVNMKPDSLQDNSLRKGLTLAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSAL

SEQ ID NO: 789 - protein, 381 aa, Unknown
  Resistance Marker For Multiple Organisms
MMMTKSLCCALLLSTSCSVLATPMSEKQLAEVVERTVTPLMKAQAIPGMAVAVIYEGQPHYFTFGKADVAANKPVTPQTLFELGSISKTFTGVLGGDAIARGEISLGDPVTKYWPELTGKQWQGIRMLDLATYTAGGLPLQVPDEVTDNASLLRFYQNWQPQWKPGTTRLYANASIGLFGALAVKPSGMSYEQAITTRVFKPLKLDHTWINVPKAEEAHYAWGYRDGKAIHVSPGMLDAEAYGVKTNVQDMASWVMVNMKPDSLQDNSLRKGLTLAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSAL

SEQ ID NO: 790 - protein, 380 aa, Unknown
  Resistance Marker For Multiple Organisms
MMTKSLCCALLLSTSCSVLAAPMSEKQLAEVVERTVTPLMKAQAIPGMAVAVIYQGQPHYFTFGKADVAANKPVTPQTLFELGSISKTFTGVLGGDAIARGEISLGDPVTKYWPELTGKQWQGIRMLDLATYTAGGLPLQVPDEVADNASLLRFYQNWQPQWKPGTTRLYANTSIGLFGALAVKPSGMSYEQAITTRVFKPLKLDHTWINVPKAEEAHYAWGYRDGKAVHVSPGMLDAEAYGVKTNVQDMASWVMVNMKPDSLQDNSLRQGIALAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSAL

SEQ ID NO: 791 - protein, 381 aa, Unknown
  Resistance Marker For Multiple Organisms
MMTKSLCCALLLSTSCSVLAAPMSEKQLAEVVERTVTPLMKAQAIPGMAVAVIYQGQPHYFTFGKADVAANKPVTPQTLFELGSISKTFTGVLGGDAIARGEISLGDPVTKYWPELTGKQWQGIRMLDLATYTAGGLPLQVPDEVTDNASLLRFYQNWQPQWKPGTTRLYANASIGLFGALAVKPSGMSYEQAITTRVFKPLKLDHTWINVPKAEEAHYAWGYRDGKAVHVSPGMLDAEAYGVKTNVKDMANWVMVNMKPDSLQDSSLKEGITLAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILDALQ

SEQ ID NO: 792 - protein, 381 aa, Unknown
  Resistance Marker For Multiple Organisms
MMRKSLCCALLLGISCSALATPVSEKQLAEVVANTVTPLMKAQSVPGMAVAVIYQGKPHYYTFGKADIAANKPVTPQTLFELGSISKTFTGVLGGDAIARGEISLDDPVTRYWPQLTGKQWQGIRMLDLATYTAGGLPLQVPDEVTDNASLLRFYQNWQPQWKPGTTRLYANASIGLFGALAVKPSGMPYEQAMTTRVLKPLKLDHTWINVPKAEEAHYAWGYRDGKAVRVSPGMLDAQAYGVKTNVQDMANWVMANMAPENVADASLKQGIALAQSRYWRIGSMYQGLGWEMLNWPVEANTVVEGSDSKVALAPLPVAEVNPPAPPVKASWVHKTGSTGGFGSYVAFIPEKQIGIVMLANTSYPNPARVEAAYHILEALQ

SEQ ID NO: 793 - protein, 381 aa, Unknown
  Resistance Marker For Multiple Organisms
MMKKSLCCALLLGISCSALAAPVSEKQLAEVVANTVTPLMKAQSIPGMAVAVIYQGKPHYYTFGKADIAASKPVTPQTLFELGSISKTFTGVLGGDAIARGEISLDDPVTRYWPQLTGKQWQGIRMLDLATYTAGGLPLQVPDEVTDNAALLRFYQNWQPQWKPGTTRLYANASIGLFGALAVKPSGMPFEQAMTTRVLKPLKLDHTWINVPKAEEAHYAWGYRDGKAVRVSPGMLDAQAYGMKTNVQDMANWVMANMAPENVADASLKQGISLAQSRYWRIGSMYQGLGWEMLNWPVEANTVIEGSDSKVALAPLPVAEVNPPAPPVKASWVHKTGSTGGFGSYVAFIPEKQIGIVMLANKSYPNPARVEAAYPILDALQ

SEQ ID NO: 794 - protein, 381 aa, Unknown
  Resistance Marker For Multiple Organisms
MMMTKSLCCALLLSTSCSVLATPMSEKQLAEVVERTVTPLMKAQAIPGMAVAVIYEGQPHYFTFGKADVAANKPVTPQTLFELGSISKTFTGVLGGDAIARGEISLGDPVTKYWPELTGKQWQGIRMLDLATYTAGGLPLQVPDEVTDNASLLRFYQNWQPQWKPGTTRLYANASIGLFGALAVKPSGMSYEQAITTRVFKPLKLDHTWINVPKAEEAHYAWGYRDGKAVHVSPGMLDAEAYGVKTNVQDMASWVMVNMKPDSLQDNSLRKGLTLAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSAL

SEQ ID NO: 795 - protein, 7 aa, Unknown
  Resistance Marker For Multiple Organisms
ADIAANK

SEQ ID NO: 796 - protein, 7 aa, Unknown
  Resistance Marker For Multiple Organisms
ADIAASK

SEQ ID NO: 797 - protein, 7 aa, Unknown
  Resistance Marker For Multiple Organisms
ADVAANK

SEQ ID NO: 798 - protein, 11 aa, Unknown
  Resistance Marker For Multiple Organisms
AEEAHYAWGYR

SEQ ID NO: 799 - protein, 17 aa, Unknown
  Resistance Marker For Multiple Organisms
AIHVSPGMLDAEAYGVK

SEQ ID NO: 800 - protein, 16 aa, Unknown
  Resistance Marker For Multiple Organisms
AQSIPGMAVAVIYQGK

SEQ ID NO: 801 - protein, 16 aa, Unknown
  Resistance Marker For Multiple Organisms
AQSVPGMAVAVIYQGK

SEQ ID NO: 802 - protein, 17 aa, Unknown
  Resistance Marker For Multiple Organisms
AVHVSPGMLDAEAYGVK

SEQ ID NO: 803 - protein, 11 aa, Unknown
  Resistance Marker For Multiple Organisms
DMANWVMVNMK

SEQ ID NO: 804 - protein, 21 aa, Unknown
  Resistance Marker For Multiple Organisms
DMANWVMVNMKPDSLQDSSLK

SEQ ID NO: 805 - protein, 7 aa, Unknown
  Resistance Marker For Multiple Organisms
DNASLLR

SEQ ID NO: 806 - protein, 9 aa, Unknown
  Resistance Marker For Multiple Organisms
EGITLAQSR

SEQ ID NO: 807 - protein, 16 aa, Unknown
  Resistance Marker For Multiple Organisms
EVNPPAPPVNASWVHK

SEQ ID NO: 808 - protein, 10 aa, Unknown
  Resistance Marker For Multiple Organisms
FYQNWQPQWK

SEQ ID NO: 809 - protein, 15 aa, Unknown
  Resistance Marker For Multiple Organisms
FYQNWQPQWKPGTTR

SEQ ID NO: 810 - protein, 11 aa, Unknown
  Resistance Marker For Multiple Organisms
GEISLDDPVTR

SEQ ID NO: 811 - protein, 11 aa, Unknown
  Resistance Marker For Multiple Organisms
GEISLGDPVTK

SEQ ID NO: 812 - protein, 8 aa, Unknown
  Resistance Marker For Multiple Organisms
GLTLAQSR

SEQ ID NO: 813 - protein, 10 aa, Unknown
  Resistance Marker For Multiple Organisms
LDHTWINVPK

SEQ ID NO: 814 - protein, 16 aa, Unknown
  Resistance Marker For Multiple Organisms
LYANASIGLFGALAVK

SEQ ID NO: 815 - protein, 16 aa, Unknown
  Resistance Marker For Multiple Organisms
LYANTSIGLFGALAVK

SEQ ID NO: 816 - protein, 21 aa, Unknown
  Resistance Marker For Multiple Organisms
MLDLATYTAGGLPLQVPDEVK

SEQ ID NO: 817 - protein, 9 aa, Unknown
  Resistance Marker For Multiple Organisms
QGIALAQSR

SEQ ID NO: 818 - protein, 9 aa, Unknown
  Resistance Marker For Multiple Organisms
QGISLAQSR

SEQ ID NO: 819 - protein, 10 aa, Unknown
  Resistance Marker For Multiple Organisms
QIGIVMLANK

SEQ ID NO: 820 - protein, 17 aa, Unknown
  Resistance Marker For Multiple Organisms
QIGIVMLANTSYPNPAR

SEQ ID NO: 821 - protein, 15 aa, Unknown
  Resistance Marker For Multiple Organisms
QLAEVVANTVTPLMK

SEQ ID NO: 822 - protein, 8 aa, Unknown
  Resistance Marker For Multiple Organisms
QLAEVVER

SEQ ID NO: 823 - protein, 10 aa, Unknown
  Resistance Marker For Multiple Organisms
QLGIVMLANK

SEQ ID NO: 824 - protein, 7 aa, Unknown
  Resistance Marker For Multiple Organisms
SYPNPAR

SEQ ID NO: 825 - protein, 13 aa, Unknown
  Resistance Marker For Multiple Organisms
TFTGVLGGDAIAR

SEQ ID NO: 826 - protein, 17 aa, Unknown
  Resistance Marker For Multiple Organisms
TGSTGGFGSYVAFIPEK

SEQ ID NO: 827 - protein, 15 aa, Unknown
  Resistance Marker For Multiple Organisms
TNVQDMASWVMVNMK

SEQ ID NO: 828 - protein, 7 aa, Unknown
  Resistance Marker For Multiple Organisms
TVTPLMK

SEQ ID NO: 829 - protein, 9 aa, Unknown
  Resistance Marker For Multiple Organisms
TVVEGSDNK

SEQ ID NO: 830 - protein, 9 aa, Unknown
  Resistance Marker For Multiple Organisms
VALAPLPAR

SEQ ID NO: 831 - protein, 19 aa, Unknown
  Resistance Marker For Multiple Organisms
VALAPLPVAEVNPPAPPVK

SEQ ID NO: 832 - protein, 6 aa, Unknown
  Resistance Marker For Multiple Organisms
VEAAYR

SEQ ID NO: 833 - protein, 6 aa, Unknown
  Resistance Marker For Multiple Organisms
VFKPLK

SEQ ID NO: 834 - protein, 20 aa, Unknown
  Resistance Marker For Multiple Organisms
VGAMYQGLGWEMLNWPVDAK

SEQ ID NO: 835 - protein, 6 aa, Unknown
  Resistance Marker For Multiple Organisms
VLKPLK

SEQ ID NO: 836 - protein, 14 aa, Unknown
  Resistance Marker For Multiple Organisms
VSPGMLDAQAYGMK

SEQ ID NO: 837 - protein, 14 aa, Unknown
  Resistance Marker For Multiple Organisms
VSPGMLDAQAYGVK

SEQ ID NO: 838 - protein, 8 aa, Unknown
  Resistance Marker For Multiple Organisms
YWPQLTGK

SEQ ID NO: 839 - protein, 6 aa, Unknown
  Resistance Marker For Multiple Organisms
ASWVHK

SEQ ID NO: 840 - protein, 6 aa, Unknown
  Resistance Marker For Multiple Organisms
QWQGIR

SEQ ID NO: 841 - protein, 8 aa, Unknown
  Resistance Marker For Multiple Organisms
YWPELTGK

SEQ ID NO: 842 - protein, 304 aa, Unknown
  Resistance Marker For Multiple Organisms
MLLYKMCDNQNYGVTYMKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID NO: 843 - protein, 304 aa, Unknown
  Resistance Marker For Multiple Organisms
MLLYKMCDNQNYGVTYMKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKLLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID NO: 844 - protein, 288 aa, Unknown
  Resistance Marker For Multiple Organisms
MKLLLVFSLLIPSMVFANSSKFQQVEQDAKVIEASLSAHIGISVLDTQTGEYWDYNGNQRFPLTSTFKTIACAKLLYDAEQGEINPKSTIEIKKADLVTYSPVIEKQVGQAITLDDACFATMTTSDNAAANIILNALGGPESVTDFLRQIGDKETRLDRIEPELNEGKLGDLRDTTTPNAIVNTLNELLFGSTLSQDGQKKLEYWMVNNQVTGNLLRSVLPEGWNIADRSGAGGFGARSITAVVWSEAQSPIIVSIYLAQTEASIADRNDAIVKIGRSIFEVYSSQSR

SEQ ID NO: 845 - protein, 288 aa, Unknown
  Resistance Marker For Multiple Organisms
MKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNQLLFGSTLSEASQKKLESWMVNNQVTGNLLRSVLPVKWSIADRSGAGGFGARSITAIVWSEEKKTIIVSIYLAQTEASMAERNDAIVKIGRSIFEVYTSQSR

SEQ ID NO: 846 - protein, 298 aa, Unknown
  Resistance Marker For Multiple Organisms
MNVRKHKASFFSVVITFLCLTLSLNANATDSVLEAVTNAETELGARIGLAVHDLETGKRWEHKSNERFPLSSTFKTLACANVLQRVDLGKERIDRVVRFSESNLVTYSPVTEKHVGKKGMSLAELCQATLSTSDNSAANFILQAIGGPKALTKFLRSIGDDTTRLDRWETELNEAVPGDKRDTTTPIAMVTTLEKLLIDETLSIKSRQQLESWLKGNEVGDALFRKGVPSDWIVADRTGAGGYGSRAITAVMWPPNRKPIVAALYITETDASFEERNAVIAKIGEQIAKTVLMENSRN

SEQ ID NO: 847 - protein, 288 aa, Unknown
  Resistance Marker For Multiple Organisms
MKFLLAFSLLIPSVVFASSSKFQQVEQDVKAIEVSLSARIGVSVLDTQNGEYWDYNGNQRFPLTSTFKTIACAKLLYDAEQGKVNSNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMAERNDAIVKIGHSIFDVYTSQSR

SEQ ID NO: 848 - protein, 288 aa, Unknown
  Resistance Marker For Multiple Organisms
MKFLLAFSLLIPSVVFASSSKFQQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGPKGVTDFLRQIGDKETRLDRIEPDLNEGKLGDLRDTTTPKAIASTLNKFLFGSALSEMNQKKLESWMVNNQVTGNLLRSVLPAGWNIADRSGAGGFGARSITAVVWSEHQAPIIVSIYLAQTQASMEERNDAIVKIGHSIFDVYTSQSR

SEQ ID NO: 849 - protein, 288 aa, Unknown
  Resistance Marker For Multiple Organisms
MKSLLVFALLMPSVVFASSSKFQSVEQEIKGIESSLSARIGVAILDTQNGESWDYNGDQRFPLTSTFKTIACAKLLYDAEHGKVNLNSTVEIKKADLVTYSPVLEKQVGKPITLSDACLATMTTSDNTAANIVINAVGDPKSITDFLRQIGDKETRLDRVEPELNEGKLGDLRDTTTPNAITSTLNQLLFGSTLSEASQKKLESWMVNNQVTGNLLRSVLPVKWSIADRSGAGGFGARSITAIVWSEEKKPIIVSIYLAQTEASMAERNDAIVKIGRSIFEVYTSQSR

SEQ ID NO: 850 - protein, 298 aa, Unknown
  Resistance Marker For Multiple Organisms
MDVRKHKASFFSVVITFLCLTLSLNANATDSVLEAVTNAETELGARIGLAVHDLETGKRWEHKSNERFPLSSTFKTLACANVLQRVDLGKERIDRVVRFSESNLVTYSPVTEKHVGKKGMSLAELCQATLSTSDNSAANFILQAIGGPKALTKFLRSIGDDTTRLDRWETELNEAVPGDKRDTTTPIAMVTTLEKLLIDETLSIKSRQQLESWLKGNEVGDALFRKGVPSDWIVADRTGAGGYGSRAITAVMWPPNRKPIVAALYITETDASFEERNAVIAKIGEQIAKTILMENSRN

SEQ ID NO: 851 - protein, 288 aa, Unknown
  Resistance Marker For Multiple Organisms
MKSLLVFALLMPSVVFASSSKFQSVEQEIKGIESSLSARIGVAILDTQNGESWDYNGDQRFPLTSTFKTIACAKLLYDAEHGKVNLNSTVEVKKADLVTYSPVLEKQVGKPITLSDACFATMTTSDNTAANIVINAVGDPKSITDFLRQIGDKETRLDRVEPELNEGKLGDLRDTTTPNAITSTLNQLLFGSTLSEASQKKLESWMVNNQVTGNLLRSVLPVTWSIADRSGAGGFGARSITAIVWSEEKKPIIVSIYLAQTEASMAERNDAIVKIGRSIFEVYTSQSR

SEQ ID NO: 852 - protein, 288 aa, Unknown
  Resistance Marker For Multiple Organisms
MKFLLVFSLLIPSVVFASSSKFRQVEQDVKAIEVSLSARIGVSVLDTQNGEYWDYNGNQRFPLTSTFKTIACAKLLYDAEQGKVNPNSTVEIKKADLVTYSPVIEKQVGQAITLDDACFATMTTSDNTAANIILSAVGGSKGVTDFLRQIGDKETRLDRIEPDLNEGKLGDLRDTTTPKAIASTLNKFLFGSALSEMNKKKLESWMVNNQVTGNLLRSVLPAGWNIADRSGAGGFGARSITAVVWSEHQAPIIVSIYLAQTQASMAERNDAIVKIGRSIFDVYTSQSR

SEQ ID NO: 853 - protein, 12 aa, Unknown
  Resistance Marker For Multiple Organisms
ADLVTYSPVIEK

SEQ ID NO: 854 - protein, 12 aa, Unknown
  Resistance Marker For Multiple Organisms
ADLVTYSPVLEK

SEQ ID NO: 855 - protein, 8 aa, Unknown
  Resistance Marker For Multiple Organisms
AIASTLNK

SEQ ID NO: 856 - protein, 21 aa, Unknown
  Resistance Marker For Multiple Organisms
AIASTLNQLLFGSTLSEASQK

SEQ ID NO: 857 - protein, 9 aa, Unknown
  Resistance Marker For Multiple Organisms
AIEVSLSAR

SEQ ID NO: 858 - protein, 11 aa, Unknown
  Resistance Marker For Multiple Organisms
AITAVMWPPNR

SEQ ID NO: 859 - protein, 14 aa, Unknown
  Resistance Marker For Multiple Organisms
DTTTPIAMVTTLEK

SEQ ID NO: 860 - protein, 6 aa, Unknown
  Resistance Marker For Multiple Organisms
DTTTPK

SEQ ID NO: 861 - protein, 12 aa, Unknown
  Resistance Marker For Multiple Organisms
FLFGSALSEMNK

SEQ ID NO: 862 - protein, 13 aa, Unknown
  Resistance Marker For Multiple Organisms
FLFGSALSEMNQK

SEQ ID NO: 863 - protein, 19 aa, Unknown
  Resistance Marker For Multiple Organisms
FLLAFSLLIPSVVFASSSK

SEQ ID NO: 864 - protein, 19 aa, Unknown
  Resistance Marker For Multiple Organisms
FLLVFSLLIPSVVFASSSK

SEQ ID NO: 865 - protein, 8 aa, Unknown
  Resistance Marker For Multiple Organisms
FPLSSTFK

SEQ ID NO: 866 - protein, 8 aa, Unknown
  Resistance Marker For Multiple Organisms
FPLTSTFK

SEQ ID NO: 867 - protein, 9 aa, Unknown
  Resistance Marker For Multiple Organisms
FQQVEQDAK

SEQ ID NO: 868 - protein, 9 aa, Unknown
  Resistance Marker For Multiple Organisms
FQQVEQDVK

SEQ ID NO: 869 - protein, 9 aa, Unknown
  Resistance Marker For Multiple Organisms
FQSVEQEIK

SEQ ID NO: 870 - protein, 15 aa, Unknown
  Resistance Marker For Multiple Organisms
FSESNLVTYSPVTEK

SEQ ID NO: 871 - protein, 9 aa, Unknown
  Resistance Marker For Multiple Organisms
GIESSLSAR

SEQ ID NO: 872 - protein, 10 aa, Unknown
  Resistance Marker For Multiple Organisms
GNEVGDALFR

SEQ ID NO: 873 - protein, 11 aa, Unknown
  Resistance Marker For Multiple Organisms
GVPSDWIVADR

SEQ ID NO: 874 - protein, 7 aa, Unknown
  Resistance Marker For Multiple Organisms
GVTDFLR

SEQ ID NO: 875 - protein, 9 aa, Unknown
  Resistance Marker For Multiple Organisms
IEPDLNEGK

SEQ ID NO: 876 - protein, 9 aa, Unknown
  Resistance Marker For Multiple Organisms
IEPELNEGK

SEQ ID NO: 877 - protein, 7 aa, Unknown
  Resistance Marker For Multiple Organisms
IGEQIAK

SEQ ID NO: 878 - protein, 12 aa, Unknown
  Resistance Marker For Multiple Organisms
IGLAVHDLETGK

SEQ ID NO: 879 - protein, 21 aa, Unknown
  Resistance Marker For Multiple Organisms
IGVAILDTQNGESWDYNGDQR

SEQ ID NO: 880 - protein, 21 aa, Unknown
  Resistance Marker For Multiple Organisms
IGVSVLDTQNGEYWDYNGNQR

SEQ ID NO: 881 - protein, 19 aa, Unknown
  Resistance Marker For Multiple Organisms
KPIIVSIYLAQTEASMAER

SEQ ID NO: 882 - protein, 19 aa, Unknown
  Resistance Marker For Multiple Organisms
KPIVAALYITETDASFEER

SEQ ID NO: 883 - protein, 16 aa, Unknown
  Resistance Marker For Multiple Organisms
LESWMVNNQVTGNLLR

SEQ ID NO: 884 - protein, 16 aa, Unknown
  Resistance Marker For Multiple Organisms
LEYWMVNNQVTGNLLR

SEQ ID NO: 885 - protein, 5 aa, Unknown
  Resistance Marker For Multiple Organisms
LGDLR

SEQ ID NO: 886 - protein, 13 aa, Unknown
  Resistance Marker For Multiple Organisms
LLFGSALSEMNQK

SEQ ID NO: 887 - protein, 10 aa, Unknown
  Resistance Marker For Multiple Organisms
LLIDETLSIK

SEQ ID NO: 888 - protein, 19 aa, Unknown
  Resistance Marker For Multiple Organisms
LLLVFSLLIPSMVFANSSK

SEQ ID NO: 889 - protein, 9 aa, Unknown
  Resistance Marker For Multiple Organisms
LLYDAEHGK

SEQ ID NO: 890 - protein, 13 aa, Unknown
  Resistance Marker For Multiple Organisms
LLYDAEQGEINPK

SEQ ID NO: 891 - protein, 9 aa, Unknown
  Resistance Marker For Multiple Organisms
LLYDAEQGK

SEQ ID NO: 892 - protein, 13 aa, Unknown
  Resistance Marker For Multiple Organisms
MCDNQNYGVTYMK

SEQ ID NO: 893 - protein, 6 aa, Unknown
  Resistance Marker For Multiple Organisms
NAVIAK

SEQ ID NO: 894 - protein, 6 aa, Unknown
  Resistance Marker For Multiple Organisms
NDAIVK

SEQ ID NO: 895 - protein, 5 aa, Unknown
  Resistance Marker For Multiple Organisms
QIGDK

SEQ ID NO: 896 - protein, 8 aa, Unknown
  Resistance Marker For Multiple Organisms
QQLESWLK

SEQ ID NO: 897 - protein, 7 aa, Unknown
  Resistance Marker For Multiple Organisms
QVEQDVK

SEQ ID NO: 898 - protein, 9 aa, Unknown
  Resistance Marker For Multiple Organisms
SGAGGFGAR

SEQ ID NO: 899 - protein, 8 aa, Unknown
  Resistance Marker For Multiple Organisms
SIGDDTTR

SEQ ID NO: 900 - protein, 11 aa, Unknown
  Resistance Marker For Multiple Organisms
SITAIVWSEEK

SEQ ID NO: 901 - protein, 7 aa, Unknown
  Resistance Marker For Multiple Organisms
SITDFLR

SEQ ID NO: 902 - protein, 19 aa, Unknown
  Resistance Marker For Multiple Organisms
SLLVFALLMPSVVFASSSK

SEQ ID NO: 903 - protein, 6 aa, Unknown
  Resistance Marker For Multiple Organisms
STIEIK

SEQ ID NO: 904 - protein, 12 aa, Unknown
  Resistance Marker For Multiple Organisms
SVLPAGWNIADR

SEQ ID NO: 905 - protein, 12 aa, Unknown
  Resistance Marker For Multiple Organisms
SVLPEGWNIADR

SEQ ID NO: 906 - protein, 6 aa, Unknown
  Resistance Marker For Multiple Organisms
SVLPVK

SEQ ID NO: 907 - protein, 12 aa, Unknown
  Resistance Marker For Multiple Organisms
SVLPVTWSIADR

SEQ ID NO: 908 - protein, 9 aa, Unknown
  Resistance Marker For Multiple Organisms
TGAGGYGSR

SEQ ID NO: 909 - protein, 6 aa, Unknown
  Resistance Marker For Multiple Organisms
TIACAK

SEQ ID NO: 910 - protein, 18 aa, Unknown
  Resistance Marker For Multiple Organisms
TIIVSIYLAQTEASMAER

SEQ ID NO: 911 - protein, 8 aa, Unknown
  Resistance Marker For Multiple Organisms
TILMENSR

SEQ ID NO: 912 - protein, 10 aa, Unknown
  Resistance Marker For Multiple Organisms
TLACANVLQR

SEQ ID NO: 913 - protein, 8 aa, Unknown
  Resistance Marker For Multiple Organisms
TVLMENSR

SEQ ID NO: 914 - protein, 5 aa, Unknown
  Resistance Marker For Multiple Organisms
VDLGK

SEQ ID NO: 915 - protein, 9 aa, Unknown
  Resistance Marker For Multiple Organisms
VEPELNEGK

SEQ ID NO: 916 - protein, 10 aa, Unknown
  Resistance Marker For Multiple Organisms
VNLNSTVEIK

SEQ ID NO: 917 - protein, 10 aa, Unknown
  Resistance Marker For Multiple Organisms
VNLNSTVEVK

SEQ ID NO: 918 - protein, 10 aa, Unknown
  Resistance Marker For Multiple Organisms
VNPNSTVEIK

SEQ ID NO: 919 - protein, 10 aa, Unknown
  Resistance Marker For Multiple Organisms
VNSNSTVEIK

SEQ ID NO: 920 - protein, 13 aa, Unknown
  Resistance Marker For Multiple Organisms
WETELNEAVPGDK

SEQ ID NO: 921 - protein, 6 aa, Unknown
  Resistance Marker For Multiple Organisms
WSIADR

SEQ ID NO: 922 - protein, 379 aa, Unknown
  Resistance Marker For Multiple Organisms
MKKSLSATLISALLAFSAPGFSAADNVAAVVDSTIKPLMAQQDIPGMAVAVSVKGKPYYFNYGFADVQAKQPVTENTLFELGSVSKTFTGVLGAVSVAKKEMMLNDPAEKYQPELALPQWKGITLLDLATYTTGGLPLQVPDAVKNRAELLHFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 923 - protein, 379 aa, Unknown
  Resistance Marker For Multiple Organisms
MKKSLSATLISALLAFSAPGFSAADNVAAVVDSTIKPLMAQQDIPGMAVAVSVKGKPYYFNYGFADIQAKQPVTENTLFELGSVSKTFTGVLGAVSVAKKEMALNDPAAKYQPELALPQWKGITLLDLATYTAGGLPLQVPDAVKSRADLLNFYQQWQPSRKPGDMRLYANSSIGLFGALTANAAGMPYEQLLTARILAPLGLSHTFITVPDSAQSQYAYGYKNKKPVRVSPGQLDAESYGVKSASKDMLRWAEMNIEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 924 - protein, 379 aa, Unknown
  Resistance Marker For Multiple Organisms
MKKSLSATLISALLAFSAPGFSAADNVAAVVDSTIKPLMAQQDIPGMAVAVSVKGKPYYFNYGFADIQAKQPVTENTLFELGSVSKTFTGVLGAVSVAKKEMALNDPAAKYQPELALPQWKGITLLDLATYTAGGLPLQVPDAVKSRADLLNFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGSGAYVAFIPEKQVAIVILANKNYPNTERVKAAQAILSALE

SEQ ID NO: 925 - protein, 379 aa, Unknown
  Resistance Marker For Multiple Organisms
MKKSLSATLISALLAFSAPGFSAADNVAAVVDSTIKPLMAQQDIPGMAVAVSVKGKPYYFNYGFADIQAKQPVTENTLFELGSVSKTFTGVLGAVSVAKKEMALNDPAAKYQPELALPQWKGITLLDLATYTAGGLPLQVPDAVKSRADLLNFYQQWQPSRKPGDMRLYANSSIGLFGALTANAAGMPYEQLLTARILAPLGLSHTFITVPESAQSQYAYGYKNKKPVRVSPGQLDAESYGVKSTSKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 926 - protein, 379 aa, Unknown
  Resistance Marker For Multiple Organisms
MKKSLSATLISALLAFSAPGFSAADNVAAVVDSTIKPLMAQQDIPGMAVAVSVKGRPYYFNYGFADVQAKQPVTENTLFELGSVSKTFTGVLGAVSVAKKEMALNDPAAKYQPELALPQWKGITLLDLATYTAGGLPLQVPDAVKSRADLLHFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 927 - protein, 379 aa, Unknown
  Resistance Marker For Multiple Organisms
MKKSLSATLISALLAFSAPGFSAADNVAAVVDSTIKPLMAQQDIPGMAVAVSVKGKPYYFNYGFADIQAKQPVTENTLFELGSVSKTFTGVLGAVSVAKKEMALNDPAAKYQPELALPQWKGITLLDLATYTAGGLPLQVPDAVKSRADLLNFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 928 - protein, 14 aa, Unknown
  Resistance Marker For Multiple Organisms
ADLLHFYQQWQPSR

SEQ ID NO: 929 - protein, 14 aa, Unknown
  Resistance Marker For Multiple Organisms
ADLLNFYQQWQPSR

SEQ ID NO: 930 - protein, 14 aa, Unknown
  Resistance Marker For Multiple Organisms
AELLHFYQQWQPSR

SEQ ID NO: 931 - protein, 16 aa, Unknown
  Resistance Marker For Multiple Organisms
AGNADLEMAMYLAQTR

SEQ ID NO: 932 - protein, 10 aa, Unknown
  Resistance Marker For Multiple Organisms
EMALNDPAAK

SEQ ID NO: 933 - protein, 10 aa, Unknown
  Resistance Marker For Multiple Organisms
EMMLNDPAEK

SEQ ID NO: 934 - protein, 16 aa, Unknown
  Resistance Marker For Multiple Organisms
GKPYYFNYGFADIQAK

SEQ ID NO: 935 - protein, 16 aa, Unknown
  Resistance Marker For Multiple Organisms
GKPYYFNYGFADVQAK

SEQ ID NO: 936 - protein, 6 aa, Unknown
  Resistance Marker For Multiple Organisms
KPGDMR

SEQ ID NO: 937 - protein, 7 aa, Unknown
  Resistance Marker For Multiple Organisms
NYPNTER

SEQ ID NO: 938 - protein, 16 aa, Unknown
  Resistance Marker For Multiple Organisms
QPVTENTLFELGSVSK

SEQ ID NO: 939 - protein, 10 aa, Unknown
  Resistance Marker For Multiple Organisms
QVAIVILANK

SEQ ID NO: 940 - protein, 19 aa, Unknown
  Resistance Marker For Multiple Organisms
TAAINQGLGWEMYDWPQQK

SEQ ID NO: 941 - protein, 13 aa, Unknown
  Resistance Marker For Multiple Organisms
TFTGVLGAVSVAK

SEQ ID NO: 942 - protein, 17 aa, Unknown
  Resistance Marker For Multiple Organisms
TGATTGFGAYVAFIPEK

SEQ ID NO: 943 - protein, 17 aa, Unknown
  Resistance Marker For Multiple Organisms
TGATTGSGAYVAFIPEK

SEQ ID NO: 944 - protein, 14 aa, Unknown
  Resistance Marker For Multiple Organisms
VSPGQLDAESYGVK

SEQ ID NO: 945 - protein, 10 aa, Unknown
  Resistance Marker For Multiple Organisms
WAEMNIEPSR

SEQ ID NO: 946 - protein, 10 aa, Unknown
  Resistance Marker For Multiple Organisms
WAEMNMEPSR

SEQ ID NO: 947 - protein, 11 aa, Unknown
  Resistance Marker For Multiple Organisms
YQPELALPQWK

SEQ ID NO: 948 - protein, 6 aa, Unknown
  Resistance Marker For Multiple Organisms
ASWVHK

SEQ ID NO: 949 - protein, 381 aa, Unknown
  Resistance Marker For Multiple Organisms
MMTKSLSCALLLSVASSAFAAPMSEKQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHFAWGYREGKAVHVSPGMLDAEAYGVKTNVKDMASWLIANMKPDSLQAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYRILDALQ

SEQ ID NO: 950 - protein, 381 aa, Unknown
  Resistance Marker For Multiple Organisms
MMTKSLSCALLLSVASAAFAAPMSETQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHYAWGYREGKAVHVSPGMLDAEAYGVKTNVKDMASWVIANMKPDSLQAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYHILDALQ

SEQ ID NO: 951 - protein, 381 aa, Unknown
  Resistance Marker For Multiple Organisms
MMTKSLSCALLLSVASAAFAAPMSEKQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHYAWGYREGKAVHVSPGMLDAEAYGVKTNVKDMASWLIANMKPDSLHAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYRILDALQ

SEQ ID NO: 952 - protein, 381 aa, Unknown
  Resistance Marker For Multiple Organisms
MMTKSLSCALLLSVASAAFAAPMFEKQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHYAWGYREGKAVHVSPGMLDAEAYGVKTNVKDMASWLIANMKPDSLHAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYRILDALQ

SEQ ID NO: 953 - protein, 381 aa, Unknown
  Resistance Marker For Multiple Organisms
MMTKSLSCALLLSVASSAFAAPMSEKQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHYAWGYREGKAVHVSPGMLDAEAYGVKTNVKDMASWLIANMKPDSLQAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYRILDALQ

SEQ ID NO: 954 - protein, 11 aa, Unknown
  Resistance Marker For Multiple Organisms
AEEAHFAWGYR

SEQ ID NO: 955 - protein, 11 aa, Unknown
  Resistance Marker For Multiple Organisms
DMASWLIANMK

SEQ ID NO: 956 - protein, 21 aa, Unknown
  Resistance Marker For Multiple Organisms
DMASWLIANMKPDSLHAPSLK

SEQ ID NO: 957 - protein, 21 aa, Unknown
  Resistance Marker For Multiple Organisms
DMASWLIANMKPDSLQAPSLK

SEQ ID NO: 958 - protein, 11 aa, Unknown
  Resistance Marker For Multiple Organisms
DMASWVIANMK

SEQ ID NO: 959 - protein, 21 aa, Unknown
  Resistance Marker For Multiple Organisms
DMASWVIANMKPDSLQAPSLK

SEQ ID NO: 960 - protein, 11 aa, Unknown
  Resistance Marker For Multiple Organisms
GEIALGDPVAK

SEQ ID NO: 961 - protein, 9 aa, Unknown
  Resistance Marker For Multiple Organisms
TVVGGSDNK

SEQ ID NO: 962 - protein, 7 aa, Unknown
  Resistance Marker For Multiple Organisms
ADVAANK

SEQ ID NO: 963 - protein, 11 aa, Unknown
  Resistance Marker For Multiple Organisms
AEEAHYAWGYR

SEQ ID NO: 964 - protein, 17 aa, Unknown
  Resistance Marker For Multiple Organisms
AVHVSPGMLDAEAYGVK

SEQ ID NO: 965 - protein, 10 aa, Unknown
  Resistance Marker For Multiple Organisms
FYQNWQPQWK

SEQ ID NO: 966 - protein, 15 aa, Unknown
  Resistance Marker For Multiple Organisms
FYQNWQPQWKPGTTR

SEQ ID NO: 967 - protein, 10 aa, Unknown
  Resistance Marker For Multiple Organisms
LDHTWINVPK

SEQ ID NO: 968 - protein, 16 aa, Unknown
  Resistance Marker For Multiple Organisms
LYANASIGLFGALAVK

SEQ ID NO: 969 - protein, 9 aa, Unknown
  Resistance Marker For Multiple Organisms
QGIALAQSR

SEQ ID NO: 970 - protein, 8 aa, Unknown
  Resistance Marker For Multiple Organisms
QLAEVVER

SEQ ID NO: 971 - protein, 10 aa, Unknown
  Resistance Marker For Multiple Organisms
QLGIVMLANK

SEQ ID NO: 972 - protein, 7 aa, Unknown
  Resistance Marker For Multiple Organisms
SYPNPAR

SEQ ID NO: 973 - protein, 13 aa, Unknown
  Resistance Marker For Multiple Organisms
TFTGVLGGDAIAR

SEQ ID NO: 974 - protein, 17 aa, Unknown
  Resistance Marker For Multiple Organisms
TGSTGGFGSYVAFIPEK

SEQ ID NO: 975 - protein, 19 aa, Unknown
  Resistance Marker For Multiple Organisms
VALAPLPVAEVNPPAPPVK

SEQ ID NO: 976 - protein, 6 aa, Unknown
  Resistance Marker For Multiple Organisms
VEAAYR

SEQ ID NO: 977 - protein, 6 aa, Unknown
  Resistance Marker For Multiple Organisms
VFKPLK

SEQ ID NO: 978 - protein, 20 aa, Unknown
  Resistance Marker For Multiple Organisms
VGAMYQGLGWEMLNWPVDAK

SEQ ID NO: 979 - protein, 6 aa, Unknown
  Resistance Marker For Multiple Organisms
ASWVHK

SEQ ID NO: 980 - protein, 6 aa, Unknown
  Resistance Marker For Multiple Organisms
QWQGIR

SEQ ID NO: 981 - protein, 8 aa, Unknown
  Resistance Marker For Multiple Organisms
YWPELTGK

SEQ ID NO: 982 - protein, 382 aa, Unknown
  Resistance Marker For Multiple Organisms
MQQRQSILWGAVATLMWAGLAHAGETSPVDPLRPVVDASIQPLLKEHRIPGMAVAVLKDGKAHYFNYGVADRERAVGVSEQTLFEIGSVSKPLTATLGAYAVVKGAMQLDDKASRHAPWLKGSAFDSITMGELATYSAGGLPLQFPEEVDSLEKMQAYYRQWTPAYSPGSHRQYSNPSIGLFGHLAASSLKQPFAQLMEQTLLPGLGLHHTYVNVPKQAMASYAYGYSKEDKPIRVSPGMLADEAYGIKTSSADLLRFVKANISGVDDKALQQAISLTHKGHYSVGGMTQGLGWERYAYPVSEQTLLAGNSAKVILEANPTAAPRESGSQMLFNKTGSTSGFGAYVAFVPAKGIGIVMLANRNYPIPARVKAAHAILTQLAR

SEQ ID NO: 983 - protein, 382 aa, Unknown
  Resistance Marker For Multiple Organisms
MQQRQSILWGALATLMWAGLAHAGDTSAVDPLRPVVDASIRPLLKEHRIPGMAVAVLKDGKAHYFNYGVADRERAVGVSEQTLFEIGSVSKPLTATLGAYAVVKGAMQLDDKASRHAPWLKGSAFDSITMGELATYSAGGLPLQFPEEVDSLEKMQAYYRQWTPAYSPGSHRQYSNPSIGLFGHLAASSMKQPFAQLMEQTLLPGLGLHHTYVNVPKQAMASYAYGYSKEDKPIRVSPGMLADEAYGIKTSSADLLRFVKANISGVDDKALQQAISLTHKGHYSVGGMTQGLGWESYAYPVSEQTLLAGNSAEVILEANPTAAPRESGNLMLFNKTGSTSGFGAYVAFVPAKGIGIVMLANRNYPIPARVKAAHAILTQLAR

SEQ ID NO: 984 - protein, 383 aa, Unknown
  Resistance Marker For Multiple Organisms
MQQRQSILWGALATLMWAGLAHAGDKAATDPLRPVVDASIRPLLKEHRIPGMAVAVLKDGKAHYFNYGVADRERAVGVSEQTLFEIGSVSKTLTATLGAYAVVQGGFELDDKASLFAPWLKGSAFDNITMGELATYSAGGLPLQFPEEVDSLEKMQAYYRQWTPAYSRGSHRQYANPSIGLFGYLAASSMKQPFDRLMEQTMLPGLGLYHTYLNVPEQPMGHYAYGYWKEDKPFRVTPAMLAEEPYGIKTSSADLLRFVKANISGVDNAAMQQAIDLTHQGQYAVGEMTQGLGWERYPYPVSEQTLLAGNSPAMIYNANPAAPAPAAAGHPVLFKKTGSTNGFGAYVAFVPAKGIGVVMLANRNYPNEGTLKAGHAILTQLAR

SEQ ID NO: 985 - protein, 383 aa, Unknown
  Resistance Marker For Multiple Organisms
MQQRQSILWGVLPTLMWAGLAHAGDRAATDPLRPVVDASIRPLLKEHRIPGMAVAVLKDGKAHYFNYGVADRERAVGVSEQTLFEIGSVSKTLTATLGAYAVVQGSFELDDKASLFAPWLKGSVFDNITMGELATYSAGGLPLQFPEEVDSLEKMQAYYRQWTPAYSPGSHRQYANPSIGLFGYLAASSMKQPFDRLMEQTILPGLGLYHTYLNVPEQAMGHYAYGYSKEDKPIRVTPGMLADEAYGIKTSSADLLRFVKANISGVDNAAMQQAIDLTHQGQYAVGEMTQGLGWERYAYPVSEQTLLAGNSAAMIYNANPAAPAPAARGHPVLFNKTGSTNGFGAYVAFVPAKGIGIVMLANRNSPIEGTLKAGHAILTQLAR

SEQ ID NO: 986 - protein, 383 aa, Unknown
  Resistance Marker For Multiple Organisms
MQQRQSILWGALATLMWAGLVHAGDKAATDPLRPVVDASIRPLLKEHRIPGMAVAVLKDGKAHYFNYGVADRERAVGVSEQTLFEIGSVSKTLTATLGAYAVVQGSFELDDKASLFAPWLKGSVFDNITMGELATYSAGGLPLQFPEEVDSLEKMQAYYRQWTPAYSPGSHRQYANPSIGLFGYLAASSMKQPFDRLMEQTMLPGLGLYHTYLTVPEQAMGHYAYGYSKEDKPIRVTPGMLADEAYGIKTSSADLLRFVKANIGGVDNAAMQQAIDLTHQGQYAVGEMTQGLGWERYAYPVSEQTLLAGNSPAMIYNAIPAVPAPAAAGHPVLFNKTGSTNGFGAYVAFVPAKGIGIVMLANRNSPIEARIKAAHAILTQLAR

SEQ ID NO: 987 - protein, 382 aa, Unknown
  Resistance Marker For Multiple Organisms
MQQRQSILWGAVATLMWAGLAHAGEASPVDPLRPVVDASIQPLLKEHRIPGMAVAVLKDGKAHYFNYGVANRESGASVSEQTLFEIGSVSKTLTATLGAYAVVKGAMQLDDKASRHAPWLKGSVFDSITMGELATYSAGGLPLQFPEEVDSSEKMRAYYRQWAPVYSPGSHRQYSNPSIGLFGHLAASSLKQPFAQLMEQTLLPGLGMHHTYVNVPKQAMASYAYGYSKEDKPIRVNPGMLADEAYGIKTSSADLLAFVKANIGGVDDKALQQAISLTHKGHYSVGGMTQGLGWESYAYPVTEQTLLAGNSAKVILEANPTAAPRESGSQVLFNKTGSSNGFGAYVAFVPARGIGIVMLANRNYPIPARVKAAHAILAQLAG

SEQ ID NO: 988 - protein, 382 aa, Unknown
  Resistance Marker For Multiple Organisms
MQQRQSILWGALATLMWAGLAHAGETSPVDPLRPVVDASIRPLLKEHRIPGMAVAVLKDGKAHYFNYGVADRERAVGVSEQTLFEIGSVSKPLTATLGAYAVVKGAMQLDDKASRHAPWLKGSAFDSITMGELATYSAGGLPLQFPEEVDSLEKMQAYYRQWTPAYSPGSHRQYSNPSIGLFGHLAASSMKQPFAQLMEQTLLPGLGLHHTYVNVPKQAMASYAYGYSKEDKPIRVSPGMLADEAYGIKTSSADLLRFVKANISGVHDKALQQAISLTHKGHYSVGGMTQGLGWESYAYPVSEQTLLAGNSAKVILEANPTAAPRESGSQMLFNKTGSTSGFGAYVAFVPAKGIGIVMLANRNYPIPARVKAAHAILTQLAR

SEQ ID NO: 989 - protein, 7 aa, Unknown
  Resistance Marker For Multiple Organisms
AATDPLR

SEQ ID NO: 990 - protein, 11 aa, Unknown
  Resistance Marker For Multiple Organisms
AHYFNYGVADR

SEQ ID NO: 991 - protein, 9 aa, Unknown
  Resistance Marker For Multiple Organisms
ANISGVDDK

SEQ ID NO: 992 - protein, 9 aa, Unknown
  Resistance Marker For Multiple Organisms
ANISGVHDK

SEQ ID NO: 993 - protein, 9 aa, Unknown
  Resistance Marker For Multiple Organisms
ASLFAPWLK

SEQ ID NO: 994 - protein, 17 aa, Unknown
  Resistance Marker For Multiple Organisms
AVGVSEQTLFEIGSVSK

SEQ ID NO: 995 - protein, 6 aa, Unknown
  Resistance Marker For Multiple Organisms
EDKPFR

SEQ ID NO: 996 - protein, 10 aa, Unknown
  Resistance Marker For Multiple Organisms
ESGNLMLFNK

SEQ ID NO: 997 - protein, 10 aa, Unknown
  Resistance Marker For Multiple Organisms
ESGSQMLFNK

SEQ ID NO: 998 - protein, 8 aa, Unknown
  Resistance Marker For Multiple Organisms
GHPVLFNK

SEQ ID NO: 999 - protein, 16 aa, Unknown
  Resistance Marker For Multiple Organisms
GHYSVGGMTQGLGWER

SEQ ID NO: 1000 - protein, 10 aa, Unknown
  Resistance Marker For Multiple Organisms
GIGVVMLANR

SEQ ID NO: 1001 - protein, 6 aa, Unknown
  Resistance Marker For Multiple Organisms
MQAYYR

SEQ ID NO: 1002 - protein, 7 aa, Unknown
  Resistance Marker For Multiple Organisms
NSPIEAR

SEQ ID NO: 1003 - protein, 9 aa, Unknown
  Resistance Marker For Multiple Organisms
NSPIEGTLK

SEQ ID NO: 1004 - protein, 9 aa, Unknown
  Resistance Marker For Multiple Organisms
NYPNEGTLK

SEQ ID NO: 1005 - protein, 5 aa, Unknown
  Resistance Marker For Multiple Organisms
QPFDR

SEQ ID NO: 1006 - protein, 12 aa, Unknown
  Resistance Marker For Multiple Organisms
QWTPAYSPGSHR

SEQ ID NO: 1007 - protein, 8 aa, Unknown
  Resistance Marker For Multiple Organisms
QWTPAYSR

SEQ ID NO: 1008 - protein, 19 aa, Unknown
  Resistance Marker For Multiple Organisms
QYANPSIGLFGYLAASSMK

SEQ ID NO: 1009 - protein, 19 aa, Unknown
  Resistance Marker For Multiple Organisms
QYSNPSIGLFGHLAASSMK

SEQ ID NO: 1010 - protein, 17 aa, Unknown
  Resistance Marker For Multiple Organisms
TGSSNGFGAYVAFVPAR

SEQ ID NO: 1011 - protein, 17 aa, Unknown
  Resistance Marker For Multiple Organisms
TGSTNGFGAYVAFVPAK

SEQ ID NO: 1012 - protein, 17 aa, Unknown
  Resistance Marker For Multiple Organisms
TGSTSGFGAYVAFVPAK

SEQ ID NO: 1013 - protein, 21 aa, Unknown
  Resistance Marker For Multiple Organisms
TLTATLGAYAVVQGGFELDDK

SEQ ID NO: 1014 - protein, 21 aa, Unknown
  Resistance Marker For Multiple Organisms
TLTATLGAYAVVQGSFELDDK

SEQ ID NO: 1015 - protein, 14 aa, Unknown
  Resistance Marker For Multiple Organisms
VSPGMLADEAYGIK

SEQ ID NO: 1016 - protein, 14 aa, Unknown
  Resistance Marker For Multiple Organisms
VTPAMLAEEPYGIK

SEQ ID NO: 1017 - protein, 14 aa, Unknown
  Resistance Marker For Multiple Organisms
VTPGMLADEAYGIK

SEQ ID NO: 1018 - protein, 17 aa, Unknown
  Resistance Marker For Multiple Organisms
YAYPVSEQTLLAGNSAK

SEQ ID NO: 1019 - protein, 11 aa, Unknown
  Resistance Marker For Multiple Organisms
ALQQAISLTHK

SEQ ID NO: 1020 - protein, 9 aa, Unknown
  Resistance Marker For Multiple Organisms
ANIGGVDDK

SEQ ID NO: 1021 - protein, 6 aa, Unknown
  Resistance Marker For Multiple Organisms
EDKPIR

SEQ ID NO: 1022 - protein, 19 aa, Unknown
  Resistance Marker For Multiple Organisms
ESGASVSEQTLFEIGSVSK

SEQ ID NO: 1023 - protein, 10 aa, Unknown
  Resistance Marker For Multiple Organisms
ESGSQVLFNK

SEQ ID NO: 1024 - protein, 8 aa, Unknown
  Resistance Marker For Multiple Organisms
GAMQLDDK

SEQ ID NO: 1025 - protein, 10 aa, Unknown
  Resistance Marker For Multiple Organisms
GIGIVMLANR

SEQ ID NO: 1026 - protein, 6 aa, Unknown
  Resistance Marker For Multiple Organisms
HAPWLK

SEQ ID NO: 1027 - protein, 7 aa, Unknown
  Resistance Marker For Multiple Organisms
NYPIPAR

SEQ ID NO: 1028 - protein, 12 aa, Unknown
  Resistance Marker For Multiple Organisms
QAMASYAYGYSK

SEQ ID NO: 1029 - protein, 12 aa, Unknown
  Resistance Marker For Multiple Organisms
QWAPVYSPGSHR

SEQ ID NO: 1030 - protein, 19 aa, Unknown
  Resistance Marker For Multiple Organisms
QYSNPSIGLFGHLAASSLK

SEQ ID NO: 1031 - protein, 13 aa, Unknown
  Resistance Marker For Multiple Organisms
TLTATLGAYAVVK

SEQ ID NO: 1032 - protein, 11 aa, Unknown
  Resistance Marker For Multiple Organisms
TSSADLLAFVK

SEQ ID NO: 1033 - protein, 8 aa, Unknown
  Resistance Marker For Multiple Organisms
TSSADLLR

SEQ ID NO: 1034 - protein, 12 aa, Unknown
  Resistance Marker For Multiple Organisms
VILEANPTAAPR

SEQ ID NO: 1035 - protein, 14 aa, Unknown
  Resistance Marker For Multiple Organisms
VNPGMLADEAYGIK

SEQ ID NO: 1036 - protein, 11 aa, Unknown
  Resistance Marker For Multiple Organisms
AHYFNYGVANR

SEQ ID NO: 1037 - protein, 10 aa, Unknown
  Resistance Marker For Multiple Organisms
IPGMAVAVLK

SEQ ID NO: 1038 - protein, 308 aa, Unknown
  Resistance Marker For Multiple Organisms
MNVIIKAVVTASTLLMVSFSSFETSAQSPLLKEQIESIVIGKKATVGVAVWGPDDLEPLLINPFEKFPMQSVFKLHLAMLVLHQVDQGKLDLNQTVIVNRAKVLQNTWAPIMKAYQGDEFSVPVQQLLQYSVSLSDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGIKAGKTAATNDLGIILLPDGRPLLVAVFVKDSAESSRTNEAIIAQVAQTAYQFELKKLSALSPN

SEQ ID NO: 1039 - protein, 308 aa, Unknown
  Resistance Marker For Multiple Organisms
MNVIIKAVVTASTLLMVSFSSFETSAQSPLLKEQIESIVIGKKATVGVAVWGPDDLEPLLINPFEKFPMQSVFKLHLAMLVLHQVDQGKLDLNQTVIVNRAKVLQNTWAPIMKAYQGDEFSVPVQQLLQYSVSHTDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGIKAGKTAATNDLGIILLPDGRPLLVAVFVKDSAESSRTNEAIIAQVAQTAYQFELKKLSALSPN

SEQ ID NO: 1040 - protein, 308 aa, Unknown
  Resistance Marker For Multiple Organisms
MNVIIKAVVTASTLLMVSFSSFETSAQSPLLKGQIESIVIGKKATVGVAVWGPDDLEPLLINPFEKFPMQSVFKLHLAMLVLHQVDQGKLDLNQTVIVNRAKVLQNTWAPIMKAYQGDEFSVPVQQLLQYSVSHSDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGIKAGKTAATNDLGIILLPDGRPLLVAVFVKDSAESSRTNEAIIAQVAQTAYQFELKKLSALSPN

SEQ ID NO: 1041 - protein, 308 aa, Unknown
  Resistance Marker For Multiple Organisms
MNVIAKGVFTTTALLMLSLSSWVVSAQSPLLKEQIETIVTGKKATVGVAVWGPDDLEPLLVNPFEKFPMQSVFKMHLAMLVLHQVDQGKLDLNKTVAVNRAAVLQNTWSPMMKDHQGDEFTVTVQQLLQYSVSHSDNVACDLLFELVGGPAALHAYIQSLGIKETEVVANEAQMHADDQVQYKNWTSMKAAAQLLRKFEQKKQLSETSQALLWKWMVETTTGPQRLKGLLPAGTVVAHKTGTSGVRAGKTAATNDIGVIMLPDGRPLLVAVFVKDSAESARTNEAIIAQVAQAAYQFELKKLSAVSPD

SEQ ID NO: 1042 - protein, 308 aa, Unknown
  Resistance Marker For Multiple Organisms
MNVIIKAVVTASTLLMVSFSSFETSAQSPLLKEQIESIVIGKKATVGVAVWGPDDLEPLLINPFEKFPMQSVFKLHLAMLVLHQVDQGKLDLNQTVIVNRAKVLQNTWAPIMKAYQGDQFSVPVQQLLQYSVSHSDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGVRAGKTAATNDLGIILLPDGRPLLVAVFVKDSAESSRTNEAIIAQVAQAAYQFELKKLSALSPN

SEQ ID NO: 1043 - protein, 308 aa, Unknown
  Resistance Marker For Multiple Organisms
MNVITKCVFTASALLMLGLSSFVVSAQSPLLKEQIETIVTGKKATVGVAVWGPDDLEPLLLNPFEKFPMQSVFKLHLAMLVLHQVDQGKLDLNQSVTVNRAAVLQNTWSPMMKDHQGDEFTVAVQQLLQYSVSHSDNVACDLLFELVGGPQALHAYIQSLGVKEAAVVANEAQMHADDQVQYQNWTSMKAAAQVLQKFEQKKQLSETSQALLWKWMVETTTGPQRLKGLLPAGTIVAHKTGTSGVRAGKTAATNDAGVIMLPDGRPLLVAVFVKDSAESERTNEAIIAQVAQAAYQFELKKLSAVSPD

SEQ ID NO: 1044 - protein, 308 aa, Unknown
  Resistance Marker For Multiple Organisms
MNVIIKAVVTASTLLMVSFSSFETSAQSPLLKEQIESIVIGKKATVGVAVWGPDDLEPLLINPFEKFPMQSVFKLHLAMLVLHQVDQGKLDLNQTVIVNRAKVLQNTWAPIMKAYQGDEFSVPVQQLLQYSVSHSDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGIKAGKTAATNDLGIILLPDGRPLLVAVFVKDSAESSRTNEAIIAQVAQTAYQFELKKLSALSPN

SEQ ID NO: 1045 - protein, 7 aa, Unknown
  Resistance Marker For Multiple Organisms
AAAQLLR

SEQ ID NO: 1046 - protein, 8 aa, Unknown
  Resistance Marker For Multiple Organisms
AAAQVLQK

SEQ ID NO: 1047 - protein, 13 aa, Unknown
  Resistance Marker For Multiple Organisms
AAVLQNTWSPMMK

SEQ ID NO: 1048 - protein, 7 aa, Unknown
  Resistance Marker For Multiple Organisms
DSAESAR

SEQ ID NO: 1049 - protein, 7 aa, Unknown
  Resistance Marker For Multiple Organisms
DSAESER

SEQ ID NO: 1050 - protein, 7 aa, Unknown
  Resistance Marker For Multiple Organisms
DSAESSR

SEQ ID NO: 1051 - protein, 10 aa, Unknown
  Resistance Marker For Multiple Organisms
EQIESIVIGK

SEQ ID NO: 1052 - protein, 10 aa, Unknown
  Resistance Marker For Multiple Organisms
EQIETIVTGK

SEQ ID NO: 1053 - protein, 20 aa, Unknown
  Resistance Marker For Multiple Organisms
ETEVVANEAQMHADDQVQYK

SEQ ID NO: 1054 - protein, 8 aa, Unknown
  Resistance Marker For Multiple Organisms
FPMQSVFK

SEQ ID NO: 1055 - protein, 7 aa, Unknown
  Resistance Marker For Multiple Organisms
GAAEILK

SEQ ID NO: 1056 - protein, 12 aa, Unknown
  Resistance Marker For Multiple Organisms
GLLPAGTIVAHK

SEQ ID NO: 1057 - protein, 12 aa, Unknown
  Resistance Marker For Multiple Organisms
GLLPAGTVVAHK

SEQ ID NO: 1058 - protein, 10 aa, Unknown
  Resistance Marker For Multiple Organisms
GQIESIVIGK

SEQ ID NO: 1059 - protein, 5 aa, Unknown
  Resistance Marker For Multiple Organisms
LDLNK

SEQ ID NO: 1060 - protein, 11 aa, Unknown
  Resistance Marker For Multiple Organisms
LDLNQSVTVNR

SEQ ID NO: 1061 - protein, 11 aa, Unknown
  Resistance Marker For Multiple Organisms
LDLNQTVIVNR

SEQ ID NO: 1062 - protein, 15 aa, Unknown
  Resistance Marker For Multiple Organisms
LHLAMLVLHQVDQGK

SEQ ID NO: 1063 - protein, 15 aa, Unknown
  Resistance Marker For Multiple Organisms
MHLAMLVLHQVDQGK

SEQ ID NO: 1064 - protein, 6 aa, Unknown
  Resistance Marker For Multiple Organisms
NWTSMK

SEQ ID NO: 1065 - protein, 12 aa, Unknown
  Resistance Marker For Multiple Organisms
QLSETSQALLWK

SEQ ID NO: 1066 - protein, 16 aa, Unknown
  Resistance Marker For Multiple Organisms
TAATNDAGVIMLPDGR

SEQ ID NO: 1067 - protein, 16 aa, Unknown
  Resistance Marker For Multiple Organisms
TAATNDIGVIMLPDGR

SEQ ID NO: 1068 - protein, 16 aa, Unknown
  Resistance Marker For Multiple Organisms
TAATNDLGIILLPDGR

SEQ ID NO: 1069 - protein, 7 aa, Unknown
  Resistance Marker For Multiple Organisms
TGTSGIK

SEQ ID NO: 1070 - protein, 7 aa, Unknown
  Resistance Marker For Multiple Organisms
TGTSGVR

SEQ ID NO: 1071 - protein, 19 aa, Unknown
  Resistance Marker For Multiple Organisms
TNEAIIAQVAQAAYQFELK

SEQ ID NO: 1072 - protein, 19 aa, Unknown
  Resistance Marker For Multiple Organisms
TNEAIIAQVAQTAYQFELK

SEQ ID NO: 1073 - protein, 13 aa, Unknown
  Resistance Marker For Multiple Organisms
TQLSETSQALLWK

SEQ ID NO: 1074 - protein, 6 aa, Unknown
  Resistance Marker For Multiple Organisms
TVAVNR

SEQ ID NO: 1075 - protein, 11 aa, Unknown
  Resistance Marker For Multiple Organisms
VLQNTWAPIMK

SEQ ID NO: 1076 - protein, 11 aa, Unknown
  Resistance Marker For Multiple Organisms
WMVETTTGPER

SEQ ID NO: 1077 - protein, 11 aa, Unknown
  Resistance Marker For Multiple Organisms
WMVETTTGPQR

SEQ ID NO: 1078 - protein, 299 aa, Unknown
  Resistance Marker For Multiple Organisms
MKIVKRILLVLLSLFFTIVYSNAQTDNLTLKIENVLKAKNARIGVAIFNSNEKDTLKINNDFHFPMQSVMKFPIALAVLSEIDKGNLSFEQKIEITPQDLLPKTWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1079 - protein, 299 aa, Unknown
  Resistance Marker For Multiple Organisms
MKIVKRILLVLLSLFFTIVYSNAQADNLTLKIENVLKAKNARIGVAIFNSNEKDTLKINNDFHFPMQSVMKFPIALAVLSEIDKGNLSFEQKIEITPQDLLPKTWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1080 - protein, 299 aa, Unknown
  Resistance Marker For Multiple Organisms
MKIVKRILLVLLSLFFTVVYSNAQTDNLTLKIENVLKAKNARIGVAIFNSNEKDTFKINNDFHFPMQSVMKFPIALAVLSEIDKGNLSFEQKIEITPQDLLPKTWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1081 - protein, 299 aa, Unknown
  Resistance Marker For Multiple Organisms
MKIVKRILLVLLSLFFTIVYSNAQADNLTLKIENVLKAKNARIGVAIFNSNEKDTLKINNDFHFPMQSVMKFPIALAVLSEIDKGNLSFEQKIEITPQDLLPKMWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1082 - protein, 299 aa, Unknown
  Resistance Marker For Multiple Organisms
MKIVKRILLVLLSLFFTVEYSNAQTDNLTLKIENVLKAKNARIGVAIFNSNEKDTLKINNDFHFPMQSVMKFPIALAVLSEIDKGNLSFEQKIEITPQDLLPKMWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1083 - protein, 299 aa, Unknown
  Resistance Marker For Multiple Organisms
MKIVKRILLVLLSLFFTVVYSNAQADNLTLKIENVLKAKNARIGVAIFNSNEKDTLKINNDFHFPMQSVMKFPIALAVLSEIDKGNLSFEQKIEITPQDLLPKMWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGIAAATNDVGVITLPNGQLIFISVFVAESKETSEINEKIISDIAKITWNYYLNK

SEQ ID NO: 1084 - protein, 299 aa, Unknown
  Resistance Marker For Multiple Organisms
MKIVKRILLVLLSLFFTVEYSNAQTDNLTLKIENVLKAKNARIGVAIFNSNEKDTLKINNDFHFPMQSVMKFPIALAVLSEIDKGNLSFEQKIEITPQDLLPKTWSPIKEEFPNGTTLTIEQILNYTVSESDNIGCDILLKLIGGTDSVQKFLNANHFTDISIKANEEQMHKDWNTQYQNWATPTAMNKLLIDTYNNKNQLLSKKSYDFIWKIMRETTTGSNRLKGQLPKNTIVAHKTGTSGINNGITAATNDVGVITLPNGQLIFISVFVAESKETSEINEKIISDIAKITWNYYLNK

SEQ ID NO: 1085 - protein, 8 aa, Unknown
  Resistance Marker For Multiple Organisms
ANEEQMHK

SEQ ID NO: 1086 - protein, 17 aa, Unknown
  Resistance Marker For Multiple Organisms
DWNTQYQNWATPTAMNK

SEQ ID NO: 1087 - protein, 8 aa, Unknown
  Resistance Marker For Multiple Organisms
ETSEINEK

SEQ ID NO: 1088 - protein, 8 aa, Unknown
  Resistance Marker For Multiple Organisms
ETTTGSNR

SEQ ID NO: 1089 - protein, 13 aa, Unknown
  Resistance Marker For Multiple Organisms
FLNANHFTDISIK

SEQ ID NO: 1090 - protein, 13 aa, Unknown
  Resistance Marker For Multiple Organisms
FPIALAVLSEIDK

SEQ ID NO: 1091 - protein, 8 aa, Unknown
  Resistance Marker For Multiple Organisms
GNLSFEQK

SEQ ID NO: 1092 - protein, 5 aa, Unknown
  Resistance Marker For Multiple Organisms
GQLPK

SEQ ID NO: 1093 - protein, 11 aa, Unknown
  Resistance Marker For Multiple Organisms
IEITPQDLLPK

SEQ ID NO: 1094 - protein, 6 aa, Unknown
  Resistance Marker For Multiple Organisms
IENVLK

SEQ ID NO: 1095 - protein, 11 aa, Unknown
  Resistance Marker For Multiple Organisms
IGVAIFNSNEK

SEQ ID NO: 1096 - protein, 7 aa, Unknown
  Resistance Marker For Multiple Organisms
IISDIAK

SEQ ID NO: 1097 - protein, 14 aa, Unknown
  Resistance Marker For Multiple Organisms
INNDFHFPMQSVMK

SEQ ID NO: 1098 - protein, 10 aa, Unknown
  Resistance Marker For Multiple Organisms
LIGGTDSVQK

SEQ ID NO: 1099 - protein, 9 aa, Unknown
  Resistance Marker For Multiple Organisms
LLIDTYNNK

SEQ ID NO: 1100 - protein, 6 aa, Unknown
  Resistance Marker For Multiple Organisms
MWSPIK

SEQ ID NO: 1101 - protein, 6 aa, Unknown
  Resistance Marker For Multiple Organisms
NQLLSK

SEQ ID NO: 1102 - protein, 7 aa, Unknown
  Resistance Marker For Multiple Organisms
NTIVAHK

SEQ ID NO: 1103 - protein, 7 aa, Unknown
  Resistance Marker For Multiple Organisms
SYDFIWK

SEQ ID NO: 1104 - protein, 6 aa, Unknown
  Resistance Marker For Multiple Organisms
TWSPIK

SEQ ID NO: 1105 - protein, 264 aa, Unknown
  Resistance Marker For Multiple Organisms
MSRLLLSGLLATGLLCAVPASAASGCFLYADGNGQTLSSEGDCSSQLPPASTFKIPLALMGYDSGFLVNEEHPALPYKPSYDGWLPAWRETTTPRRWETYSVVWFSQQITEWLGMERFQQYVDRFDYGNRDLSGNPGKHDGLTQAWLSSSLAISPEEQARFLGKMVSGKLPVSAQTLQYTANILKVSEVEGWQIHGKTGMGYPKKLDGSLNRDQQIGWFVGWASKPGKQLIFVHTVVQKPGKQFASIKAKEEVLAALPAQLKKL

SEQ ID NO: 1106 - protein, 257 aa, Unknown
  Resistance Marker For Multiple Organisms
IACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1107 - protein, 274 aa, Unknown
  Resistance Marker For Multiple Organisms
MKKILLLHMLVFVSATLPISSVASDEVETLKCTIIADAITGNTLYETGECARRVSPCSSFKLPLAIMGFDSGILQSPKSPTWELKPEYNPSPRDRTYKQVYPALWQSDSVVWFSQQLTSRLGVDRFTEYVKKFEYGNQDVSGDSGKHNGLTQSWLMSSLTISPKEQIQFLLRFVAHKLPVSEAAYDMAYATIPQYQAAEGWAVHGKSGSGWLRDNNGKINESRPQGWFVGWAEKNGRQVVFARLEIGKEKSDIPGGSKAREDILVELPVLMGNK

SEQ ID NO: 1108 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNAGPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1109 - protein, 275 aa, Unknown
  Resistance Marker For Multiple Organisms
MQRSLSMSGKRHFIFAVSFVISTVCLTFSPANAAQKLSCTLVIDEASGDLLHREGSCDKAFAPMSTFKLPLAIMGYDADILLDATTPRWDYKPEFNGYKSQQKPTDPTIWLKDSIVWYSQELTRRLGESRFSDYVQRFDYGNKDVSGDPGKHNGLTHAWLASSLKISPEEQVRFLRRFLRGELPVSEDALEMTKAVVPHFEAGDWDVQGKTGTGSLSDAKGGKAPIGWFIGWATRDDRRVVFARLTVGARKGEQPAGPAARDEFLNTLPALSENF

SEQ ID NO: 1110 - protein, 266 aa, Unknown
  Resistance Marker For Multiple Organisms
MKTFAAYVIIACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1111 - protein, 257 aa, Unknown
  Resistance Marker For Multiple Organisms
IACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQITREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1112 - protein, 257 aa, Unknown
  Resistance Marker For Multiple Organisms
IACLSSTALAGSITENTSWNKEFSAEAVNGVFVLCKSSSKSCATNDLARASKEYLPASTFKIPSAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1113 - protein, 266 aa, Unknown
  Resistance Marker For Multiple Organisms
MIIRFLALLFSAVVLVSLGHAQEKTHESSNWGKYFSDFNAKGTIVVVDERTNGNSTSVYNESRAQQRYSPASTFKIPHTLFALDAGAVRDEFHVFRWDGAKRSFAGHNQDQNLRSAMRNSTVWVYQLFAKEIGENKARSYLEKLNYGNADPSTKSGDYWIDGNLAISANEQISILKKLYRNELPFRVEHQRLVKDLMIVEAKRDWILRAKTGWDGQMGWWVGWVEWPTGPVFFALNIDTPNRMEDLHKREAIARAILQSVNALPPN

SEQ ID NO: 1114 - protein, 275 aa, Unknown
  Resistance Marker For Multiple Organisms
MAIRIFAILFSTFVFGTFAHAQEGMRERSDWRKFFSEFQAKGTIVVADERQTDRVILVFDQVRSEKRYSPASTFKIPHTLFALDAGAARDEFQVFRWDGIKRSFAAHNQDQDLRSAMRNSTVWIYELFAKEIGEDKARRYLKQIDYGNADPSTSNGDYWIDGNLAIAAQEQIAFLRKLYHNELPFRVEHQRLVKDLMIVEAGRNWILRAKTGWEGRIGWWVGWVEWPTGPVFFALNIDTPNRMDDLFKREAIVRAILRSIEALPPNPAVNSDAAR

SEQ ID NO: 1115 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPSAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1116 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEDQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1117 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFGLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1118 - protein, 276 aa, Unknown
  Resistance Marker For Multiple Organisms
MKNTIHINFAIFLIIANIIYSSASASTDISTVASPLFEGTEGCFLLYDASTNAEIAQFNKAKCATQMAPDSTFKIALSLMAFDAEIIDQKTIFKWDKTPKGMEIWNSNHTPKTWMQFSVVWVSQEITQKIGLNKIKNYLKDFDYGNQDFSGDKERNNGLTEAWLESSLKISPEEQIQFLRKIINHNLPVKNSAIENTIENMYLQDLDNSTKLYGKTGAGFTANRTLQNGWFEGFIISKSGHKYVFVSALTGNLGSNLTSSIKAKKNAITILNTLNL

SEQ ID NO: 1119 - protein, 256 aa, Unknown
  Resistance Marker For Multiple Organisms
ANIIYSSASASTDISTVASPLFEGTEGCFLLYDVSTNAEIAQFNKAKCATQMAPDSTFKIALSLMAFDAEIIDQKTIFKWDKTPKGMEIWNSNHTPKTWMQFSVVWVSQEITQKIGLNKIKNYLKDFDYGNQDFSGDKERNNGLTEAWLESSLKISPEEQIQFLRKIINHNLPVKNSAIENTIENMYLQDLENSTKLYGKTGAGFTANRTLQNGWFEGFIISKSGHKYVFVSALTGNLGSNLTSSIKAKKNAITIL

SEQ ID NO: 1120 - protein, 246 aa, Unknown
  Resistance Marker For Multiple Organisms
IFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNAYPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAIL

SEQ ID NO: 1121 - protein, 266 aa, Unknown
  Resistance Marker For Multiple Organisms
MIIRFLALLFSAVVLVSLGHAQDKTHESSNWGKYFSDFNAKGTIVVVDERTNGNSTSVYNESRAQQRYSPASTFKIPHTLFALDAGAVRDEFHVFRWDGAKRSFAGHNQDQNLRSAMRNSTVWVYQLFAKEIGENKARSYLEKLNYGNADPSTKSGDYWIDGNLAISANEQISILKKLYRNELPFRVEHQRLVKDLMIVEAKRDWILRAKTGWDGQMGWWVGWVEWPTGPVFFALNIDTPNRMEDLHKREAIARAILQSVNALPPN

SEQ ID NO: 1122 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVEKMLLIKEVNGSKIYAKSGWGMGVTPQVGWLTGWVEQANGKKIPFSLNLEMKEGMSGSIRNEITYKLLENLGII

SEQ ID NO: 1123 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMTGSIRNEITYKSLENLGII

SEQ ID NO: 1124 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKADINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALKMEMRSEMPASIRNELLMKSLKQLNII

SEQ ID NO: 1125 - protein, 257 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYCIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAIL

SEQ ID NO: 1126 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1127 - protein, 266 aa, Unknown
  Resistance Marker For Multiple Organisms
MAIRFLTILLSTFFLTSFVHAQEHVLERSDWKKFFSDLRAEGAIVISDERQAEHALLVFGQERAAKRYSPASTFKLPHTLFALDADAVRDEFQVFRWDGVKRSFAGHNQDQDLRSAMRNSAVWVYELFAKEIGKDKARHYLKQIDYGNADPSTIKGDYWIDGNLEISAHEQISFLRKLYRNQLPFQVEHQRLVKDLMITEAGRNWILRAKTGWEGRFGWWVGWVEWPTGPVFFALNIDTPNRTDDLFKREAIARAILRSIDALPPN

SEQ ID NO: 1128 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIEGSIAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1129 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMSGSIRNEITYKSLENLGII

SEQ ID NO: 1130 - protein, 266 aa, Unknown
  Resistance Marker For Multiple Organisms
MAIRFLTILLSTFFLTSFVHAQEHVLERSDWKKFFSDLRAEGAIVISDERQAEHALLVFGQERAAKRYSPASTFKLPHTLFALDADAVRDEFQVFRWDGVKRSFAGHNQDQDLRSAMRNSAVWVYELFAKEIGEDKARRYLKQIDYGNADPSTIKGDYWIDGNLEISAHEQISFLRKLYRNQLPFQVEHQRLVKDLMITEAGRNWILRAKTGWEGRFGWWVGWVEWPTGPVFFALNIDTPNRTDDLFKREAIARAILRSIDALPPN

SEQ ID NO: 1131 - protein, 266 aa, Unknown
  Resistance Marker For Multiple Organisms
MAIRFFTILLSTFFLTSFVYAQEHVVIRSDWKKFFSDLQAEGAIVIADERQAKHTLSVFDQERAAKRYSPASTFKIPHTLFALDADAVRDEFQVFRWDGVNRSFAGHNQDQDLRSAMRNSTVWVYELFAKDIGEDKARRYLKQIDYGNVDPSTIKGDYWIDGNLKISAHEQILFLRKLYRNQLPFKVEHQRLVKDLMITEAGRSWILRAKTGWEGRFGWWVGWIEWPTGPVFFALNIDTPNRTDDLFKREAIARAILRSIDALPPN

SEQ ID NO: 1132 - protein, 274 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVERIGFGNAEIGQQVDNFWLVGPLKVTPIQEVEFVSQLAHTQLPFSEKVQANVKNMLLLEESNGYKIFGKTGWAAMDIKPQVGWLTGWVEQPDGKIVAFALNMEMRSEMPASIRNELLMKSLKQLNII

SEQ ID NO: 1133 - protein, 275 aa, Unknown
  Resistance Marker For Multiple Organisms
MAIQIFAILFSTFVLATFAHAQDGTLERSDWGKFFSDFQAKGTIVVADERQADHAILVFDQARSMKRYSPASTFKIPHTLFALDAGAVRDEFQIFRWDGVKRSFAGHNKDQDLRSAMRNSTVWVYELFAKEIGDGKARRYLKQIGYGNADPSTSHGDYWIEGSLAISAQEQIAFLRKLYQNDLPFRVEHQRLVKDLMIVEAGRNWILRAKTGWEGSMGWWVGWVEWPTGPVFFALNIDTPNRMDDLFKREAIARAILLSIEALPPNPAVHSDAAR

SEQ ID NO: 1134 - protein, 276 aa, Unknown
  Resistance Marker For Multiple Organisms
MKNTIHINFAIFLIIANIIYSSASASTDISTVASQLFEGTEGCFLLYDASTNAEIAQFNKAKCAAQMAPDSTFKIALSLMAFDAEIIDQKTIFKWDKIPKGMEIWNSNHTPKTWMQFSVVWVSQEITQKIGLNKIKNYLKDFDYGNQDFSGDKERNNGLTEAWLESSLKISPEEQIQFLRKIINHNLPVRNSAIENTIDNMYLQDLENSTKLYGKTGAGFTANRTLQNGWFEGFIISKSGHKYVFVSALTGSLGSNLTSSIKAKKNAITILNTLNL

SEQ ID NO: 1135 - protein, 254 aa, Unknown
  Resistance Marker For Multiple Organisms
MLLFMFSIISFGNENQFMKEIFERKGLNGTFVVYDLKNDKIDYYNLDRANERFYPASSFKIFNTLIGLENGIVKNVDEMFYYYDGSKVFLDSWAKDSNLRYAIKVSQVPAYKKLARELGKERMQEGLNKLNYGNKEIGSEIDKFWLEGPLKISAMEQVKLLNLLSQSKLPFKLENQEQVKDITILEKKDDFILHGKTGWATDNIVVPIGWFVGWIETSDNIYSFAINLDISDSKFLPKREEIVREYFKNINVIK

SEQ ID NO: 1136 - protein, 265 aa, Unknown
  Resistance Marker For Multiple Organisms
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYSTRIEPKIGWWVGWVELDDNVWFFAMNMDMPTSDGLGLRQAITKEVLKQEKIIP

SEQ ID NO: 1137 - protein, 271 aa, Unknown
  Resistance Marker For Multiple Organisms
MLSRYSKTLAFAVVACTLAISTATAHAELVVRNDLKRVFDDAGVSGTFVLMDITADRTYVVDPARAARSIHPASTFKIPNSLIAFDTGAVRDDQEVLPYGGKPQPYEQWEHDMALPEAIRLSAVPIYQEVARRVGFERMQAYVDAFDYGNRQLGSAIDQFWLRGPLEISAFEEARFTSRMALKQLPVKPRTWDMVQRMLLIEQQGDAALYAKTGVATEYQPEIGWWAGWVERAGHVYAFALNIDMPREGDMAKRIPLGKQLMRALEVWPAP

SEQ ID NO: 1138 - protein, 262 aa, Unknown
  Resistance Marker For Multiple Organisms
MRPLLFSALLLLSGHTQASEWNDSQAVDKLFGAAGVKGTFVLYDVQRQRYVGHDRERAETRFVPASTYKVANSLIGLSTGAVRSADEVLPYGGKPQRFKAWEHDMSLRDAIKASNVPVYQELARRIGLERMRANVSRLGYGNAEIGQVVDNFWLVGPLKISAMEQTRFLLRLAQGELPFPAPVQSTVRAMTLLESGPGWELHGKTGWCFDCTPELGWWVGWVKRNERLYGFALNIDMPGGEADIGKRVELGKASLKALGILP

SEQ ID NO: 1139 - protein, 289 aa, Unknown
  Resistance Marker For Multiple Organisms
MNKGLHRKRLSKRLLLPMLLCLLAQQTQAVAAEQTKVSDVCSEVTAEGWQEVRRWDKLFESAGVKGSLLLWDQKRSLGLSNNLSRAAEGFIPASTFKLPSSLIALETGAVRDETSRFSWDGKVREIAVWNRDQSFRTAMKYSVVPVYQQLAREIGPKVMAAMVRQLEYGNQDIGGQADSFWLDGQLRITAFQQVDFLRQLHDNKLPVSERSQRIVKQMMLTEASTDYIIRAKTGYGVRRTPAIGWWVGWLELDDNTVYFAVNLDLASASQLPLRQQLVKQVLKQEQLLP

SEQ ID NO: 1140 - protein, 285 aa, Unknown
  Resistance Marker For Multiple Organisms
MNTIISRRWRAGLWRRLVGAVVLPATLAATPAAYAADVPKAALGRITERADWGKLFAAEGVKGTIVVLDARTQTYQAYDAARAEKRMSPASTYKIFNSLLALDSGALDNERAIIPWDGKPRRIKNWNAAMDLRTAFRVSCLPCYQVVSHKIGRRYAQAKLNEVGYGNRTIGGAPDAYWVDDSLQISAREQVDFVQRLARGTLPFSARSQDIVRQMSIVEATPDYVLHGKTGWFVDKKPDIGWWVGWIERDGNITSVAINIDMLSEADAPKRARIVKAVLKDLKLI

SEQ ID NO: 1141 - protein, 266 aa, Unknown
  Resistance Marker For Multiple Organisms
MKTFAAYVITACLSSTALASSITENTFWNKEFSAEAVNGVFVLCKSSSKSCATNNLARASKEYLPASTFKIPNAIIGLETGVIKNEHQIFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGAEVYFFAFNMDIDNENKLPLRKSIPTKIMASEGIIGG

SEQ ID NO: 1142 - protein, 265 aa, Unknown
  Resistance Marker For Multiple Organisms
MRVLALSAVLVVASIVGMPAMANEWQEKPSWNTHFSEHKAQGVIVLWNENKQQGFTNNLKRANQAFLPASTFKIPNSLIALDLGVVKDEHQVFKWDGQTRDIAAWNRDHDLITAMKYSVVPVYQEFARQIGQARMSKMLHAFDYGNEDISGNLDSFWLDGGIRISATEQVAFLRKLYHNKLHVSERSQRIVKQAMLTEANSDYIIRAKTGYSTRIEPQIGWWVGWVELDDNVWFFAMNMDMPTADGLGLRQAITKEVLKQEKIIP

SEQ ID NO: 1143 - protein, 257 aa, Unknown
  Resistance Marker For Multiple Organisms
MKKITLFLLFLNLVFGQDKILNNWFKEYNTSGTFVFYDGKTWASNDFSRAMETFSPASTFKIFNALIALDSGVIKTKKEIFYHYRGEKVFLSSWAQDMNLSSAIKYSNVLAFKEVARRIGIKTMQEYLNKLHYGNAKISKIDTFWLDNSLKISAKEQAILLFRLSQNSLPFSQEAMNSVKEMIYLKNMENLELFGKTGFNDGQKIAWIVGFVYLKDENKYKAFALNLDIDKFEDLYKREKILEKYLDELVKKVKNDG

SEQ ID NO: 1144 - protein, 268 aa, Unknown
  Resistance Marker For Multiple Organisms
MSKKNFILIFIFVILISCKNTEKISNETTLIDNIFTNSNAEGTLVIYNLNDDKYIIHNKERAEQRFYPASTFKIYNSLIGLNEKAVKDVDEVFYKLMAKSFLESWAKDSNLRYAIKNSQVPAYKELARRIGIKKMKENIEKLDFGNKSIGDSVDTFWLEGPLEISAMEQVKLLTKLAQNELQYPIEIQKAISDITITRANLHITLHGKTGLADSKNMTTEPIGWFVGWLEENDNIYVFALNIDNINSDDLAKRINIVKESLKALNLLK

SEQ ID NO: 1145 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALKMEMRSEMPASIRNELLMKSLKQLNII

SEQ ID NO: 1146 - protein, 274 aa, Unknown
  Resistance Marker For Multiple Organisms
MNIQALLLITSAIFISACSPYIVTANPNYSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRIGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGISSSVRKEITYRGLEQLGIL

SEQ ID NO: 1147 - protein, 274 aa, Unknown
  Resistance Marker For Multiple Organisms
MNIKALLLITSAIFISACSPYIVTANPNHSASKSDEKGEKIKNLFNEAHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1148 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1149 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1150 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1151 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1152 - protein, 274 aa, Unknown
  Resistance Marker For Multiple Organisms
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQHEVQSMLFIEEKNGNKIYAKSGWGWDVDPQVGWLTGWVVQPQGNIVAFSLNLEMKKGIPSSVRKEITYKSLEQLGIL

SEQ ID NO: 1153 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKTTTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1154 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTAVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGTPSSVRKEITYKSLEQLGIL

SEQ ID NO: 1155 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLPRRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1156 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEKLGIL

SEQ ID NO: 1157 - protein, 274 aa, Unknown
  Resistance Marker For Multiple Organisms
MNIKTLLLITSTIFISACSPYIVTANPNHSTSKSDEKAEKIKNLFNEAHTTGVLVIQQGQTQQSYGNDLARASIEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1158 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAISVYQDLARRIGLELMSKEVKRVGYGNADIGTQVDNFWLAGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1159 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASALPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1160 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGSVVQPQGNIVAFSLNLEMKKGIPSSVRKEITYKSLEQLGIL

SEQ ID NO: 1161 - protein, 274 aa, Unknown
  Resistance Marker For Multiple Organisms
MNIKTLLLITSTIFISACSPYIVTANPNHSTSKSDEKAEKIKNLFNEAHTTGVLVIQQGQTQQSYGNDLARASIEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKAQDEVQSMLFIEEKNGNKIYAKSGWGWDVDPQVGWLTGWVVQPQGNIVAFSLNLEMKKGIPSSVRKEITYKSLEQLGIL

SEQ ID NO: 1162 - protein, 274 aa, Unknown
  Resistance Marker For Multiple Organisms
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1163 - protein, 274 aa, Unknown
  Resistance Marker For Multiple Organisms
MNIKTLLLITSAIFISACSHYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFTYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1164 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1165 - protein, 274 aa, Unknown
  Resistance Marker For Multiple Organisms
MNIKALLLITSTIFISACSPYIVTANPNHSASKSDEKAEKIKNLFNEAHTTGVLVIQQGQTQQSYGNDLARASTEYVPASTFKMLNALISLEHHKATTTEVFKWDGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1166 - protein, 274 aa, Unknown
  Resistance Marker For Multiple Organisms
MNIQALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPHGNIVAFSLNLEMKKGIPSSVRKEITYKSLEQLGIL

SEQ ID NO: 1167 - protein, 274 aa, Unknown
  Resistance Marker For Multiple Organisms
MNIKALFLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1168 - protein, 280 aa, Unknown
  Resistance Marker For Multiple Organisms
MKLLKILSLVCLSISIGACAEHSMSRAKTSTIPQVNNSIIDQNVQALFNEISADAVFVTYDGQNIKKYGTHLDRAKTAYIPASTFKIANALIGLENHKATSTEIFKWDGKPRFFKAWDKDFTLGEAMQASTVPVYQELARRIGPSLMQSELQRIGYGNMQMGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 1169 - protein, 274 aa, Unknown
  Resistance Marker For Multiple Organisms
MNIKALLLITSTIFISACSPYIVTANPNHSTSKSDEKAEKIKNLFNEAHTTGVLVIQQGQTQQSYGNDLARASTEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1170 - protein, 274 aa, Unknown
  Resistance Marker For Multiple Organisms
MNIKTLLLITSAIFISACSPYIVTANPNHSASKSDEKAEKIKNLFNEVHTTGVLVIRQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEMNGNKIYAKSGWGWDVDPQVGWLTGWVVQPQGNIVAFSLNLEMKKGIPSSVRKEITYKSLEQLGIL

SEQ ID NO: 1171 - protein, 280 aa, Unknown
  Resistance Marker For Multiple Organisms
MKLLKILSLVCLSISIGACAEHSMSRAKTSTIPQVNNSIIDQNVQALFNEISGDAVFVTYDGQNIKKYGTHLDRAKTAYIPASTFKIANALIGLENHKATSTEIFKWDGKPRFFKAWDKDFTLGEAMQASTVPVYQELARRIGPSLMQSELQRIGYGNMQIGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 1172 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMDVTPQVGWLTGWVEQANGKKIPFSLNLEMKEGMSGSIRNEITYKSLENLGII

SEQ ID NO: 1173 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIESSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1174 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1175 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1176 - protein, 274 aa, Unknown
  Resistance Marker For Multiple Organisms
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1177 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1178 - protein, 274 aa, Unknown
  Resistance Marker For Multiple Organisms
MNIKALLLITSAIFISACSPYIVTTNPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNTDIGTQVDNFWVVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1179 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIQVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1180 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASALPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1181 - protein, 274 aa, Unknown
  Resistance Marker For Multiple Organisms
MNIKTLLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEMNGNKIYAKSGWGWDVDPQVGWLTGWVVQPQGNIVAFSLNLEMKKGIPSSVRKEITYKSLEQLGIL

SEQ ID NO: 1182 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFPLNLEMKKGIPSSVRKEITYKSLEQLGIL

SEQ ID NO: 1183 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGGDVNPQVGWLTGWVVQPQGNIVAFSLNLEMKKGIPSSVRKEITYKSLEQLGIL

SEQ ID NO: 1184 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1185 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1186 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKTTTTEVFKWDGQKRLFPEWEKDMTLGDAMKASAIPVYQDLARRIGLELMSKEVKRVGYGNADIGTQVDNFWVVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1187 - protein, 269 aa, Unknown
  Resistance Marker For Multiple Organisms
MSKKNFILIFIFVILISCKNTEKISNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLKKMKENIEKLDFGNKSIGDSVDTFWLEGPLEISAMEQVKLLTKLAQNELPYPIEIQKAVSDITILEQTYNYTLHGKTGLADSKNMTTEPIGWFVGWLEENDNIYVFALNIDNINSDDLAKRINIVKESLKALNLLK

SEQ ID NO: 1188 - protein, 269 aa, Unknown
  Resistance Marker For Multiple Organisms
MSKKNFILIFIFVILTSCKNTEKISNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLKKMKENIEKLDFGNKSIGDSVDTFWLEGPLEISAMEQIKLLTKLAQNELPYPIEIQKAVSDITILEQTYNYTLHGKTGLADSKNMTTEPIGWFVGWLEENDNIYVFALNIDNINSDDLAKRINIVKESLKALNLLK

SEQ ID NO: 1189 - protein, 262 aa, Unknown
  Resistance Marker For Multiple Organisms
LLITSAIFISACSPYIVSANPNHSASKSDDKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSL

SEQ ID NO: 1190 - protein, 262 aa, Unknown
  Resistance Marker For Multiple Organisms
LLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTEWVVQPQGNIVAFSLNLEMKKGIPSSVRKEITYKSL

SEQ ID NO: 1191 - protein, 275 aa, Unknown
  Resistance Marker For Multiple Organisms
MTVRRLSCALGAALSLSALGGGPVQAAVLCTVVADAADGRILFQQGTQQACAERYTPASTFKLAIALMGADAGILQGPHEPVWNYQPAYPDWGGDAWRQPTDPARWIKYSVVWYSQLTAKALGQDRFQRYTSAFGYGNADVSGEPGKHNGTDGAWIISSLRISPLEQLAFLRKLVNRQLPVKAAAYELAENLFEAGQADGWRLYGKTGTGSPGSNGVYTAANAYGWFVGWARKDGRQLVYARLLQDERATRPNAGLRARDELVRDWPAMAGAWRP

SEQ ID NO: 1192 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNVLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1193 - protein, 266 aa, Unknown
  Resistance Marker For Multiple Organisms
MKTFAAYVIIACLSSTALAGSITENTSWNKEFSAEAVNGVFVLCKSSSKSCATNDLARASKEYLPASTFKIPSAIIGLETGVIKNEHQVFKWDGKPRAMKQWERDLTLRGAIQVSAVPVFQQIAREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1194 - protein, 274 aa, Unknown
  Resistance Marker For Multiple Organisms
MNIKTLLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1195 - protein, 274 aa, Unknown
  Resistance Marker For Multiple Organisms
MNIKALLLITSAIFISACSPYIVTTNPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNTDIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1196 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNQQVGWLTGWVVQPQGNIVAFSLNLEMKKGIPSSVRKEITYKSLEQLGIL

SEQ ID NO: 1197 - protein, 274 aa, Unknown
  Resistance Marker For Multiple Organisms
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEMTYKSLEQLGIL

SEQ ID NO: 1198 - protein, 273 aa, Unknown
  Resistance Marker For Multiple Organisms
MNKYFTCYVVASLFFSGCTVQHNLINETQSQIVQGHNQVIHQYFDEKNTSGVLVIQTDKKINLYGNALSRANTEYVPASTFKMLNALIGLENQKTDINEIFKWKGEKRSFTTWEKDMTLGEAMKLSAVPVYQELARRIGLDLMQKEVERIDFGNAEIGQQVDNFWLIGPLKVTPIQEVEFVSQLAHTQLPFSEKVQANVKNMLLLEENNGYKIFGKTGWAMDIKPQVGWLTGWVEQPDGKIVAFALNMEMRSEMPASIRNELLMKSLKQLNII

SEQ ID NO: 1199 - protein, 274 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAAMDIKPQVGWLTGWVEQPDGKIVAFALNMEMRSEMPASIRNELLMKSLKQLNII

SEQ ID NO: 1200 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFLLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1201 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGDADPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1202 - protein, 274 aa, Unknown
  Resistance Marker For Multiple Organisms
MNIKALLLITSAIFISACSPYIVTANPNHSASKSDKKAEKIKNLFNEAHTTGVLVIQQGQTQQSYGNDLARASTEYVPASTFKMLNALIGLEHHKASTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVKSMLFIEEKNGNKIYAKSGWGWDVDPQVGWLTGWVVQPQGNIVAFSLNLEMKKGIPSSVRKEITYKSLEQLGIL

SEQ ID NO: 1203 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKHVGYGNADIGTQVDNFWLVGPLKITPQQEAQFAYKLANKTLPFSPKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1204 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKHVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1205 - protein, 275 aa, Unknown
  Resistance Marker For Multiple Organisms
MKKFILPILSISTLLSVSACSSIQTKFEDTFHTSNQQHEKAIKSYFDEAQTQGVIIIKKGKNISTYGNNLTRAHTEYVPASTFKMLNALIGLENHKATTTEIFKWDGKKRSYPMWEKDMTLGDAMALSAVPVYQELARRTGLDLMQKEVKRVGFGNMNIGTQVDNFWLVGPLKITPIQEVNFADDFANNRLPFKLETQEEVKKMLLIKEFNGSKIYAKSGWGMDVTPQVGWLTGWVEKSNGEKVAFSLNIEMKQGMPGSIRNEITYKSLENLGII

SEQ ID NO: 1206 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSILFIEEKNGNKIYAKSGWGWDVNPQVGWLTGWVVQPQGNIVAFSLNLEMKKGIPSSVRKEITYKSLEQLGIL

SEQ ID NO: 1207 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTSQVGWLTGWVEQANGKKIPFSLNLEMKEGMSGSIRNEITYKSLENLGII

SEQ ID NO: 1208 - protein, 265 aa, Unknown
  Resistance Marker For Multiple Organisms
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYSARIEPKIGWWVGWVELDDNVWFFAMNMDMPTSDGLGLRQAITKEVLKQEKIIP

SEQ ID NO: 1209 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGLDVNPQVGWLTGWVVQPQGNIVAFSLNLEMKKGIPSSVRKEITYKSLEQLGIL

SEQ ID NO: 1210 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGLDVNLQVGWLTGWVVQPQGNIVAFSLNLEMKKGIPSSVRKEITYKSLEQLGIL

SEQ ID NO: 1211 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEKLGIL

SEQ ID NO: 1212 - protein, 274 aa, Unknown
  Resistance Marker For Multiple Organisms
MNIKALLLITSAIFISACSPYIVTANPNHSASKSDVKAEKIRNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1213 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDSKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1214 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDGVQSMLFIEEKNGNKIYAKSGWGWDVNPQVGWLTGWVVQPQGNIVAFSLNLEMKKGIPSSVRKEITYKSLEQLGIL

SEQ ID NO: 1215 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDSKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1216 - protein, 280 aa, Unknown
  Resistance Marker For Multiple Organisms
MKLLKILSLVCLSISIGACAEHSMSRAKTSTIPQVNNSIIDQNVQALFNEISADAVFVTYDGQNIKKYGTHLDRAKTAYIPASTFKIANALIGLENHKATSTEIFKWDGKPRFLKAWDKDFTLGEAMQASTVPVYQELARRIGPSLMQSELQRIGYGNMQIGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 1217 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDVKPQVGWLTGWVEQPDGKIVAFALNMEMRSEMPASIRNELLMKSLKQLNII

SEQ ID NO: 1218 - protein, 273 aa, Unknown
  Resistance Marker For Multiple Organisms
MNKYFTCYVVASLFLSGCTVQHNLINETPSQIVQGHNQVIHQYFDEKNTSGALVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 1219 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELMMKSLKQLNII

SEQ ID NO: 1220 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLAGWVEQPDGKIVAFALNMEMRSEMPASIRNELLMKSLKQLNII

SEQ ID NO: 1221 - protein, 273 aa, Unknown
  Resistance Marker For Multiple Organisms
MNKYFTCYVVASLFLSGCTVQHNLINETPSQIVQGHNQVIHQYFDERNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 1222 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEKSNGYKIFGKTGWAMDIKPQVGWLTGWVEQPDGKIVAFALNMEMRSEMPASIRNELLMKSLKQLNII

SEQ ID NO: 1223 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASTRNELLMKSLKQLNII

SEQ ID NO: 1224 - protein, 275 aa, Unknown
  Resistance Marker For Multiple Organisms
MKKFILPIFSISILLSLSACSSIQTKFEDTFHISNQKHEKAIKSYFDEAQTQGVIIIKEGKNISSYGNNLVRAHTEYVPASTFKMLNALIGLENHKATTNEIFKWDGKKRSYPMWEKDMTLGEAMALSAVPVYQDLARRIGLNLMQKEVKRVGFGNMNIGTQVDNFWLIGPLKITPIQEVNFADDLANNRLPFKLETQEEVKKMLLIKEVNGSKIYAKSGWGMDVSPQVGWLTGWVEKSNGEKVSFSLNIEMKQGMSGSIRNEITYKSLENLGII

SEQ ID NO: 1225 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAMKASAIAVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1226 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAIKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1227 - protein, 273 aa, Unknown
  Resistance Marker For Multiple Organisms
MKILIFLPLLSCLGLTACSLPVSSLPSQSISTQAIASLFDQAQSSGVLVIQRDQQVQVYGNDLNRANTEYVPASTFKMLNALIGLQHGKATTNEIFKWDGKKRSFTAWEKDMTLGQAMQASAVPVYQELARRIGLELMQQEVQRIQFGNQQIGQQVDNFWLVGPLKVTPKQEVQFVSALAREQLAFDPQVQQQVKAMLFLQERKAYRLYVKSGWGMDVEPQVGWLTGWVETPQAEIVAFSLNMQMQNGIDPAIRLEILQQALAELGLYPKAEG

SEQ ID NO: 1228 - protein, 262 aa, Unknown
  Resistance Marker For Multiple Organisms
MHKHMSKLFIAFLAFLLSVPAAAEDQTLAELFAQQGIDGTIVISSLHNGKTFIHNDPRAKQRFSTASTFKILNTLISLEEKAISGKDDVLKWDGHIYDFPDWNRDQTLESAFKVSCVWCYQALARQVGAEKYRNYLRKSVYGELREPFEETTFWLDGSLQISAIEQVNFLKKVHLRTLPFSASSYETLRQIMLIEQTPAFTLRAKTGWATRVKPQVGWYVGHVETPTDVWFFATNIEVRDEKDLPLRQKLTRKALQAKGIIE

SEQ ID NO: 1229 - protein, 266 aa, Unknown
  Resistance Marker For Multiple Organisms
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGTDKFWLEDQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1230 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGLDVDPQVGWLTGWVVQPQGNIVAFSLNLEMKKGIPSSVRKEITYKSLEQLGIL

SEQ ID NO: 1231 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIQVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1232 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAMPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1233 - protein, 274 aa, Unknown
  Resistance Marker For Multiple Organisms
MNIKALLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGKKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1234 - protein, 261 aa, Unknown
  Resistance Marker For Multiple Organisms
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYDTKIGWWVGWVELDDNVWFFAMNMDMPTSDGLGLRQAITKEVLKQEKIIP

SEQ ID NO: 1235 - protein, 269 aa, Unknown
  Resistance Marker For Multiple Organisms
MSKKNFILIFIFVILISCKNTEKTSNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLEKMKENIEKLDFGNKNIGDSVDTFWLEGPLEISAMEQVKLLTKLAQNELPYPIEIQKAVSDITILEQTDNYTLHGKTGLADSENMTTEPIGWLVGWLEENNNIYVFALNIDNINSDDLAKRINIVKESLKALNLLK

SEQ ID NO: 1236 - protein, 274 aa, Unknown
  Resistance Marker For Multiple Organisms
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1237 - protein, 274 aa, Unknown
  Resistance Marker For Multiple Organisms
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPSSQKVQDEVQSMLFIEEKNGNKMYAKSGWGWDVNPQVGWLTGWVVQPQGNIVAFSLNLEMKKGIPSSVRKEITYKSLEQLGIL

SEQ ID NO: 1238 - protein, 274 aa, Unknown
  Resistance Marker For Multiple Organisms
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEIAYKSLEQLGIL

SEQ ID NO: 1239 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDCWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1240 - protein, 274 aa, Unknown
  Resistance Marker For Multiple Organisms
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWVVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1241 - protein, 274 aa, Unknown
  Resistance Marker For Multiple Organisms
MNIKTLLLITSAIFISACSPYIVTANPNHSASKSDEKAEKIKNLFNEVHTTGVLVIQQGQTQQSYGNDLARASTEYVPASTFKMLNALIGLEYHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1242 - protein, 266 aa, Unknown
  Resistance Marker For Multiple Organisms
MAIRFLTILLSTFFLTSFVHAQEHVVVRSDWKKFFSDLQAEGAIVIADERQAEHALLVFGQERAAKRYSPASTFKLPHTLFALDAGAVRDEFQVFRWDGVKRSFAGHNQDQDLRSAMRNSAVWVYELFAKEIGEDNARRYLKQIDYGNADPSTIKGNYWIDGNLEISAHEQISFLRKLYRNQLPFQVEHQRLVKYLMITEAGRNWILRAKTGWEGRFGWWIGWVEWPTGPVFFALNIDTPNRTDDLFKREAIARAILRSIDALPPN

SEQ ID NO: 1243 - protein, 265 aa, Unknown
  Resistance Marker For Multiple Organisms
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIAAWNRDHDLITAMKYSVVPVYQEFARQIGEARMSKMLHAFDYGNEDISGNVDSFWLDGGIRISATQQIAFLRKLYHNKLHVSERSQRIVKQAMLTEANGDYIIRAKTGYSTRIEPKIGWWVGWVELDDNVWFFAMNMDMPTSDGLGLRQAITKEVLKQEKIIP

SEQ ID NO: 1244 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKSQVGWLTGWVEQPDGKIVAFALNMEMRSEMPASIRNELLMKSLKQLNII

SEQ ID NO: 1245 - protein, 274 aa, Unknown
  Resistance Marker For Multiple Organisms
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAISVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1246 - protein, 275 aa, Unknown
  Resistance Marker For Multiple Organisms
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 1247 - protein, 267 aa, Unknown
  Resistance Marker For Multiple Organisms
MKTIAAYLVLVFYASTALSESISENLAWNKEFSSESVHGVFVLCKSSSNSCTTNNAARASTAYIPASTFKIPNALIGLETGAIKDERQVFKWDGKPRAMKQWEKDLKLRGAIQVSAVPVFQQIAREVGEIRMQKYLNLFSYGNANIGGGIDKFWLEGQLRISAFNQVKFLESLYLNNLPASKANQLIVKEAIVTEATPEYIVHSKTGYSGVGTESSPGVAWWVGWVEKGTEVYFFAFNMDIDNESKLPSRKSISTKIMASEGIIIGG

SEQ ID NO: 1248 - protein, 266 aa, Unknown
  Resistance Marker For Multiple Organisms
MKTFAAYVITACLSSTALASSITENTFWNKEFSAEAVNGVFVLCKSSSKLACATNNLARASKEYLPASTFKIPNAIIGLETGVIKNEHQIFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAPEYLVHSKTGFSGVGTESNPGVAWWVGWVEKGAEVYFFAFNMDIDNENKLPLRKSIPTKIMASEGIIGG

SEQ ID NO: 1249 - protein, 275 aa, Unknown
  Resistance Marker For Multiple Organisms
MAIRIFAILFSTFVFGTFAHAQEGMRERSDWRKFFSEFQAKGTIVVADERQTDRVILVFDQVRSEKRYSPASTFKIPHTLFALDAGAARDEFQVFRWDGIKRSFAAHNQDQDLRSAMRNSTVWIYELFAKEIGEDKARRYLKQIDYGNADPSTSNGDYWIDGNLAIAAQEQIAFLRKLYHNELPFRVEHQRLVKDLMIVEAGRNWILRAKTGWEGRMGWWVGWVEWPTGPVFFALNIDTPNRMDDLFKREAIVRAILRSIEALPPNPAVNSDAAR

SEQ ID NO: 1250 - protein, 266 aa, Unknown
  Resistance Marker For Multiple Organisms
MKTFAAYVIIACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGSQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1251 - protein, 273 aa, Unknown
  Resistance Marker For Multiple Organisms
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 1252 - protein, 266 aa, Unknown
  Resistance Marker For Multiple Organisms
MKKLSVLLWLTLFYCGTIWAQSTCFLVQENQTVLKHEGKDCNKRFAPESTFKIALSLMGFDSGILKDTLNPEWPYKKEYELYLNVWKYPHNPRTWIRDSCVWYSQVLTQQLGMTRFKNYVDAFHYGNQDISGDKGQNNGLTHSWLSSSLAISPSEQIQFLQKIVNKKLSVNPKAFTMTKDILYIQELAGGWKLYGKTGNGRQLTKDKSQKLSLQHGWFIGWIEKDGRVITFTKHIADSKKHVTFASFRAKNETLNQLFYLINELEK

SEQ ID NO: 1253 - protein, 274 aa, Unknown
  Resistance Marker For Multiple Organisms
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1254 - protein, 269 aa, Unknown
  Resistance Marker For Multiple Organisms
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGNQTLVFARLTQDERKQPVSAGIRTREAFLRDLPRLLAAR

SEQ ID NO: 1255 - protein, 269 aa, Unknown
  Resistance Marker For Multiple Organisms
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYPVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 1256 - protein, 264 aa, Unknown
  Resistance Marker For Multiple Organisms
MRGKHTVILGAALSALFAGAAGAQMLECTLVADAASGQELYRKGACDKAFAPMSTFKVPLAVMGYDAGILVDAHNPRWDYKPEFNGYKFQQKTTDPTIWEKDSIVWYSQQLTRKMGQKRFAAYVAGFGYGNGDISGEPGKSNGLTHSWLGSSLKISPEGQVRFVRDLLSAKLPASKDAQQMTVSILPHFAAGDWAVQGKTGTGSFIDARGAKAPLGWFIGWATHEERRVVFARMTAGGKKGEQPAGPAARDAFLKALPDLAKRF

SEQ ID NO: 1257 - protein, 269 aa, Unknown
  Resistance Marker For Multiple Organisms
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLDRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 1258 - protein, 269 aa, Unknown
  Resistance Marker For Multiple Organisms
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 1259 - protein, 266 aa, Unknown
  Resistance Marker For Multiple Organisms
MKTFAAYVIIACLSSTALAGSITENTSWNKEFSAEAVNGVFVLCKSSSKSCATNDLARASKEYLPVSTFKIPSAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 1260 - protein, 274 aa, Unknown
  Resistance Marker For Multiple Organisms
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1261 - protein, 274 aa, Unknown
  Resistance Marker For Multiple Organisms
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 1262 - protein, 266 aa, Unknown
  Resistance Marker For Multiple Organisms
MKTFAAYVITACLSSTALASSITENTFWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 1263 - protein, 267 aa, Unknown
  Resistance Marker For Multiple Organisms
MKTIAAYLVLVFFAGTALSESISENLAWNKEFSSESVHGVFVLCKSSSNSCTTNNATRASTAYIPASTFKIPNALIGLETGAIKDARQVFKWDGKPRAMKQWEKDLTLRGAIQVSAVPVFQQIARDIGKKRMQKYLNLFSYGNANIGGGIDKFWLEGQLRISAVNQVKFLESLYLNNLPASKANQLIVKEAIVTEATPEYIVHSKTGYSGVGTESNPGVAWWVGWVEKGTEVYFFAFNMDIDNESKLPSRKSIPTKIMASEGIIIGG

SEQ ID NO: 1264 - protein, 275 aa, Unknown
  Resistance Marker For Multiple Organisms
MKKFILPIFSISILVSLSACSSIKTKSEDNFHISSQQHEKAIKSYFDEAQTQGVIIIKEGKNLSTYGNALARANKEYVPASTFKMLIALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMSGSIRNEITYKSLENLGII

SEQ ID NO: 1265 - protein, 274 aa, Unknown
  Resistance Marker For Multiple Organisms
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1266 - protein, 274 aa, Unknown
  Resistance Marker For Multiple Organisms
MNIKALLLITSAISISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAIKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 1267 - protein, 20 aa, Unknown
  Resistance Marker For Multiple Organisms
AAAYELAENLFEAGQADGWR

SEQ ID NO: 1268 - protein, 12 aa, Unknown
  Resistance Marker For Multiple Organisms
AAEGFIPASTFK

SEQ ID NO: 1269 - protein, 5 aa, Unknown
  Resistance Marker For Multiple Organisms
AALGR

SEQ ID NO: 1270 - protein, 15 aa, Unknown
  Resistance Marker For Multiple Organisms
ADGQVVAFALNMQMK

SEQ ID NO: 1271 - protein, 8 aa, Unknown
  Resistance Marker For Multiple Organisms
ADINEIFK

SEQ ID NO: 1272 - protein, 5 aa, Unknown
  Resistance Marker For Multiple Organisms
ADWGK

SEQ ID NO: 1273 - protein, 11 aa, Unknown
  Resistance Marker For Multiple Organisms
AEGAIVISDER

SEQ ID NO: 1274 - protein, 10 aa, Unknown
  Resistance Marker For Multiple Organisms
AFALNLDIDK

SEQ ID NO: 1275 - protein, 9 aa, Unknown
  Resistance Marker For Multiple Organisms
AFAPMSTFK

SEQ ID NO: 1276 - protein, 21 aa, Unknown
  Resistance Marker For Multiple Organisms
AFGYGNADVSGDPGQNNGLDR

SEQ ID NO: 1277 - protein, 6 aa, Unknown
  Resistance Marker For Multiple Organisms
AFTMTK

SEQ ID NO: 1278 - protein, 8 aa, Unknown
  Resistance Marker For Multiple Organisms
AGDDIALR

SEQ ID NO: 1279 - protein, 15 aa, Unknown
  Resistance Marker For Multiple Organisms
AGHVYAFALNIDMPR

SEQ ID NO: 1280 - protein, 5 aa, Unknown
  Resistance Marker For Multiple Organisms
AGLWR

SEQ ID NO: 1281 - protein, 12 aa, Unknown
  Resistance Marker For Multiple Organisms
AHTEYVPASTFK

SEQ ID NO: 1282 - protein, 8 aa, Unknown
  Resistance Marker For Multiple Organisms
AIIPWDGK

SEQ ID NO: 1283 - protein, 10 aa, Unknown
  Resistance Marker For Multiple Organisms
AIIPWDGKPR

SEQ ID NO: 1284 - protein, 9 aa, Unknown
  Resistance Marker For Multiple Organisms
AISDITITR

SEQ ID NO: 1285 - protein, 5 aa, Unknown
  Resistance Marker For Multiple Organisms
AISGK

SEQ ID NO: 1286 - protein, 6 aa, Unknown
  Resistance Marker For Multiple Organisms
ALGQDR

SEQ ID NO: 1287 - protein, 7 aa, Unknown
  Resistance Marker For Multiple Organisms
ALPDLAK

SEQ ID NO: 1288 - protein, 5 aa, Unknown
  Resistance Marker For Multiple Organisms
ALQAK

SEQ ID NO: 1289 - protein, 12 aa, Unknown
  Resistance Marker For Multiple Organisms
AMETFSPASTFK

SEQ ID NO: 1290 - protein, 8 aa, Unknown
  Resistance Marker For Multiple Organisms
AMLFLQER

SEQ ID NO: 1291 - protein, 9 aa, Unknown
  Resistance Marker For Multiple Organisms
AMLVFDPVR

SEQ ID NO: 1292 - protein, 16 aa, Unknown
  Resistance Marker For Multiple Organisms
AMTLLESGPGWELHGK

SEQ ID NO: 1293 - protein, 10 aa, Unknown
  Resistance Marker For Multiple Organisms
ANLHITLHGK

SEQ ID NO: 1294 - protein, 7 aa, Unknown
  Resistance Marker For Multiple Organisms
ANQLIVK

SEQ ID NO: 1295 - protein, 12 aa, Unknown
  Resistance Marker For Multiple Organisms
ANTEYVPASTFK

SEQ ID NO: 1296 - protein, 5 aa, Unknown
  Resistance Marker For Multiple Organisms
ANVSR

SEQ ID NO: 1297 - protein, 12 aa, Unknown
  Resistance Marker For Multiple Organisms
APIGWFIGWATR

SEQ ID NO: 1298 - protein, 15 aa, Unknown
  Resistance Marker For Multiple Organisms
APLGWFIGWATHEER

SEQ ID NO: 1299 - protein, 14 aa, Unknown
  Resistance Marker For Multiple Organisms
AQDEVQSMLFIEEK

SEQ ID NO: 1300 - protein, 12 aa, Unknown
  Resistance Marker For Multiple Organisms
AQGVIVLWNENK

SEQ ID NO: 1301 - protein, 12 aa, Unknown
  Resistance Marker For Multiple Organisms
ASAIAVYQDLAR

SEQ ID NO: 1302 - protein, 12 aa, Unknown
  Resistance Marker For Multiple Organisms
ASAILVYQDLAR

SEQ ID NO: 1303 - protein, 12 aa, Unknown
  Resistance Marker For Multiple Organisms
ASAIPVYQDLAR

SEQ ID NO: 1304 - protein, 12 aa, Unknown
  Resistance Marker For Multiple Organisms
ASAIPVYQDLPR

SEQ ID NO: 1305 - protein, 12 aa, Unknown
  Resistance Marker For Multiple Organisms
ASAIQVYQDLAR

SEQ ID NO: 1306 - protein, 12 aa, Unknown
  Resistance Marker For Multiple Organisms
ASAISVYQDLAR

SEQ ID NO: 1307 - protein, 12 aa, Unknown
  Resistance Marker For Multiple Organisms
ASALPVYQDLAR

SEQ ID NO: 1308 - protein, 12 aa, Unknown
  Resistance Marker For Multiple Organisms
ASAMPVYQDLAR

SEQ ID NO: 1309 - protein, 12 aa, Unknown
  Resistance Marker For Multiple Organisms
ASAVPVYQDLAR

SEQ ID NO: 1310 - protein, 12 aa, Unknown
  Resistance Marker For Multiple Organisms
ASIEYVPASTFK

SEQ ID NO: 1311 - protein, 12 aa, Unknown
  Resistance Marker For Multiple Organisms
ASNVPVYQELAR

SEQ ID NO: 1312 - protein, 8 aa, Unknown
  Resistance Marker For Multiple Organisms
ASPASTFK

SEQ ID NO: 1313 - protein, 12 aa, Unknown
  Resistance Marker For Multiple Organisms
ASTAYIPASTFK

SEQ ID NO: 1314 - protein, 12 aa, Unknown
  Resistance Marker For Multiple Organisms
ASTEYVPASTFK

SEQ ID NO: 1315 - protein, 8 aa, Unknown
  Resistance Marker For Multiple Organisms
ASTTEVFK

SEQ ID NO: 1316 - protein, 8 aa, Unknown
  Resistance Marker For Multiple Organisms
ATSTEIFK

SEQ ID NO: 1317 - protein, 8 aa, Unknown
  Resistance Marker For Multiple Organisms
ATTNEIFK

SEQ ID NO: 1318 - protein, 8 aa, Unknown
  Resistance Marker For Multiple Organisms
ATTTAVFK

SEQ ID NO: 1319 - protein, 8 aa, Unknown
  Resistance Marker For Multiple Organisms
ATTTEIFK

SEQ ID NO: 1320 - protein, 8 aa, Unknown
  Resistance Marker For Multiple Organisms
ATTTEVFK

SEQ ID NO: 1321 - protein, 19 aa, Unknown
  Resistance Marker For Multiple Organisms
AVSDITILEQTDNYTLHGK

SEQ ID NO: 1322 - protein, 19 aa, Unknown
  Resistance Marker For Multiple Organisms
AVSDITILEQTYNYTLHGK

SEQ ID NO: 1323 - protein, 16 aa, Unknown
  Resistance Marker For Multiple Organisms
AVVPHFEAGDWDVQGK

SEQ ID NO: 1324 - protein, 9 aa, Unknown
  Resistance Marker For Multiple Organisms
AWEHDMSLR

SEQ ID NO: 1325 - protein, 20 aa, Unknown
  Resistance Marker For Multiple Organisms
AWIGSSLQISPLEQLEFLGK

SEQ ID NO: 1326 - protein, 12 aa, Unknown
  Resistance Marker For Multiple Organisms
CAAQMAPDSTFK

SEQ ID NO: 1327 - protein, 12 aa, Unknown
  Resistance Marker For Multiple Organisms
CATQMAPDSTFK

SEQ ID NO: 1328 - protein, 21 aa, Unknown
  Resistance Marker For Multiple Organisms
CTIIADAITGNTLYETGECAR

SEQ ID NO: 1329 - protein, 5 aa, Unknown
  Resistance Marker For Multiple Organisms
DAFLK

SEQ ID NO: 1330 - protein, 8 aa, Unknown
  Resistance Marker For Multiple Organisms
DDFILHGK

SEQ ID NO: 1331 - protein, 11 aa, Unknown
  Resistance Marker For Multiple Organisms
DDQEVLPYGGK

SEQ ID NO: 1332 - protein, 5 aa, Unknown
  Resistance Marker For Multiple Organisms
DDVLK

SEQ ID NO: 1333 - protein, 7 aa, Unknown
  Resistance Marker For Multiple Organisms
DEFHVFR

SEQ ID NO: 1334 - protein, 7 aa, Unknown
  Resistance Marker For Multiple Organisms
DEFQIFR

SEQ ID NO: 1335 - protein, 7 aa, Unknown
  Resistance Marker For Multiple Organisms
DEFQVFR

SEQ ID NO: 1336 - protein, 5 aa, Unknown
  Resistance Marker For Multiple Organisms
DELVR

SEQ ID NO: 1337 - protein, 5 aa, Unknown
  Resistance Marker For Multiple Organisms
DETSR

SEQ ID NO: 1338 - protein, 13 aa, Unknown
  Resistance Marker For Multiple Organisms
DFDYGNQDFSGDK

SEQ ID NO: 1339 - protein, 21 aa, Unknown
  Resistance Marker For Multiple Organisms
DFTLGEAMQASTVPVYQELAR

SEQ ID NO: 1340 - protein, 21 aa, Unknown
  Resistance Marker For Multiple Organisms
DGNITSVAINIDMLSEADAPK

SEQ ID NO: 1341 - protein, 9 aa, Unknown
  Resistance Marker For Multiple Organisms
DHDLITAMK

SEQ ID NO: 1342 - protein, 7 aa, Unknown
  Resistance Marker For Multiple Organisms
DIAAWNR

SEQ ID NO: 1343 - protein, 6 aa, Unknown
  Resistance Marker For Multiple Organisms
DIGEDK

SEQ ID NO: 1344 - protein, 13 aa, Unknown
  Resistance Marker For Multiple Organisms
DILYIQELAGGWK

SEQ ID NO: 1345 - protein, 7 aa, Unknown
  Resistance Marker For Multiple Organisms
DITILEK

SEQ ID NO: 1346 - protein, 6 aa, Unknown
  Resistance Marker For Multiple Organisms
DLLSAK

SEQ ID NO: 1347 - protein, 9 aa, Unknown
  Resistance Marker For Multiple Organisms
DLMITEAGR

SEQ ID NO: 1348 - protein, 9 aa, Unknown
  Resistance Marker For Multiple Organisms
DLMIVEAGR

SEQ ID NO: 1349 - protein, 8 aa, Unknown
  Resistance Marker For Multiple Organisms
DLMIVEAK

SEQ ID NO: 1350 - protein, 5 aa, Unknown
  Resistance Marker For Multiple Organisms
DLPLR

SEQ ID NO: 1351 - protein, 8 aa, Unknown
  Resistance Marker For Multiple Organisms
DLSGNPGK

SEQ ID NO: 1352 - protein, 5 aa, Unknown
  Resistance Marker For Multiple Organisms
DLSLR

SEQ ID NO: 1353 - protein, 5 aa, Unknown
  Resistance Marker For Multiple Organisms
DLTLR

SEQ ID NO: 1354 - protein, 9 aa, Unknown
  Resistance Marker For Multiple Organisms
DMTLGDAIK

SEQ ID NO: 1355 - protein, 21 aa, Unknown
  Resistance Marker For Multiple Organisms
DMTLGDAMALSAVPVYQELAR

SEQ ID NO: 1356 - protein, 9 aa, Unknown
  Resistance Marker For Multiple Organisms
DMTLGDAMK

SEQ ID NO: 1357 - protein, 21 aa, Unknown
  Resistance Marker For Multiple Organisms
DMTLGEAMALSAVPVYQDLAR

SEQ ID NO: 1358 - protein, 21 aa, Unknown
  Resistance Marker For Multiple Organisms
DMTLGEAMALSAVPVYQELAR

SEQ ID NO: 1359 - protein, 9 aa, Unknown
  Resistance Marker For Multiple Organisms
DMTLGEAMK

SEQ ID NO: 1360 - protein, 21 aa, Unknown
  Resistance Marker For Multiple Organisms
DMTLGQAMQASAVPVYQELAR

SEQ ID NO: 1361 - protein, 5 aa, Unknown
  Resistance Marker For Multiple Organisms
DNNGK

SEQ ID NO: 1362 - protein, 5 aa, Unknown
  Resistance Marker For Multiple Organisms
DQDLR

SEQ ID NO: 1363 - protein, 13 aa, Unknown
  Resistance Marker For Multiple Organisms
DQQIGWFVGWASK

SEQ ID NO: 1364 - protein, 16 aa, Unknown
  Resistance Marker For Multiple Organisms
DQQIGWFVGWASKPGK

SEQ ID NO: 1365 - protein, 13 aa, Unknown
  Resistance Marker For Multiple Organisms
DQQVQVYGNDLNR

SEQ ID NO: 1366 - protein, 5 aa, Unknown
  Resistance Marker For Multiple Organisms
DQSFR

SEQ ID NO: 1367 - protein, 9 aa, Unknown
  Resistance Marker For Multiple Organisms
DQTLESAFK

SEQ ID NO: 1368 - protein, 18 aa, Unknown
  Resistance Marker For Multiple Organisms
DSCVWYSQVLTQQLGMTR

SEQ ID NO: 1369 - protein, 12 aa, Unknown
  Resistance Marker For Multiple Organisms
DSIVWYSQELTR

SEQ ID NO: 1370 - protein, 12 aa, Unknown
  Resistance Marker For Multiple Organisms
DSIVWYSQQLTR

SEQ ID NO: 1371 - protein, 5 aa, Unknown
  Resistance Marker For Multiple Organisms
DSNLR

SEQ ID NO: 1372 - protein, 12 aa, Unknown
  Resistance Marker For Multiple Organisms
DSYIAWGGEAWK

SEQ ID NO: 1373 - protein, 10 aa, Unknown
  Resistance Marker For Multiple Organisms
DTLNPEWPYK

SEQ ID NO: 1374 - protein, 8 aa, Unknown
  Resistance Marker For Multiple Organisms
DVDEVFYK

SEQ ID NO: 1375 - protein, 8 aa, Unknown
  Resistance Marker For Multiple Organisms
DVSGDPGK

SEQ ID NO: 1376 - protein, 5 aa, Unknown
  Resistance Marker For Multiple Organisms
DWILR

SEQ ID NO: 1377 - protein, 10 aa, Unknown
  Resistance Marker For Multiple Organisms
DWPAMAGAWR

SEQ ID NO: 1378 - protein, 5 aa, Unknown
  Resistance Marker For Multiple Organisms
EAFLR

SEQ ID NO: 1379 - protein, 5 aa, Unknown
  Resistance Marker For Multiple Organisms
EAIAR

SEQ ID NO: 1380 - protein, 5 aa, Unknown
  Resistance Marker For Multiple Organisms
EAIVR

SEQ ID NO: 1381 - protein, 16 aa, Unknown
  Resistance Marker For Multiple Organisms
EAIVTEATPEYIVHSK

SEQ ID NO: 1382 - protein, 16 aa, Unknown
  Resistance Marker For Multiple Organisms
EALVTEAAPEYLVHSK

SEQ ID NO: 1383 - protein, 15 aa, Unknown
  Resistance Marker For Multiple Organisms
EALVTEAPEYLVHSK

SEQ ID NO: 1384 - protein, 5 aa, Unknown
  Resistance Marker For Multiple Organisms
EEIVR

SEQ ID NO: 1385 - protein, 12 aa, Unknown
  Resistance Marker For Multiple Organisms
EEVLAALPAQLK

SEQ ID NO: 1386 - protein, 6 aa, Unknown
  Resistance Marker For Multiple Organisms
EFNGSK

SEQ ID NO: 1387 - protein, 15 aa, Unknown
  Resistance Marker For Multiple Organisms
EFSAEAVNGVFVLCK

SEQ ID NO: 1388 - protein, 15 aa, Unknown
  Resistance Marker For Multiple Organisms
EFSSESVHGVFVLCK

SEQ ID NO: 1389 - protein, 6 aa, Unknown
  Resistance Marker For Multiple Organisms
EGDMAK

SEQ ID NO: 1390 - protein, 8 aa, Unknown
  Resistance Marker For Multiple Organisms
EGMSGSIR

SEQ ID NO: 1391 - protein, 8 aa, Unknown
  Resistance Marker For Multiple Organisms
EGMTGSIR

SEQ ID NO: 1392 - protein, 6 aa, Unknown
  Resistance Marker For Multiple Organisms
EGSCDK

SEQ ID NO: 1393 - protein, 7 aa, Unknown
  Resistance Marker For Multiple Organisms
EIAVWNR

SEQ ID NO: 1394 - protein, 5 aa, Unknown
  Resistance Marker For Multiple Organisms
EIAYK

SEQ ID NO: 1395 - protein, 5 aa, Unknown
  Resistance Marker For Multiple Organisms
EIFER

SEQ ID NO: 1396 - protein, 7 aa, Unknown
  Resistance Marker For Multiple Organisms
EIFYHYR

SEQ ID NO: 1397 - protein, 6 aa, Unknown
  Resistance Marker For Multiple Organisms
EIGDDK

SEQ ID NO: 1398 - protein, 6 aa, Unknown
  Resistance Marker For Multiple Organisms
EIGDGK

SEQ ID NO: 1399 - protein, 6 aa, Unknown
  Resistance Marker For Multiple Organisms
EIGEDK

SEQ ID NO: 1400 - protein, 8 aa, Unknown
  Resistance Marker For Multiple Organisms
EIGEDNAR

SEQ ID NO: 1401 - protein, 6 aa, Unknown
  Resistance Marker For Multiple Organisms
EIGENK

SEQ ID NO: 1402 - protein, 5 aa, Unknown
  Resistance Marker For Multiple Organisms
EIGPK

SEQ ID NO: 1403 - protein, 8 aa, Unknown
  Resistance Marker For Multiple Organisms
EIGSEIDK

SEQ ID NO: 1404 - protein, 5 aa, Unknown
  Resistance Marker For Multiple Organisms
EITYK

SEQ ID NO: 1405 - protein, 5 aa, Unknown
  Resistance Marker For Multiple Organisms
EITYR

SEQ ID NO: 1406 - protein, 6 aa, Unknown
  Resistance Marker For Multiple Organisms
EMIYLK

SEQ ID NO: 1407 - protein, 7 aa, Unknown
  Resistance Marker For Multiple Organisms
EMLYVER

SEQ ID NO: 1408 - protein, 5 aa, Unknown
  Resistance Marker For Multiple Organisms
EMTYK

SEQ ID NO: 1409 - protein, 5 aa, Unknown
  Resistance Marker For Multiple Organisms
ENIEK

SEQ ID NO: 1410 - protein, 7 aa, Unknown
  Resistance Marker For Multiple Organisms
ENQLIVK

SEQ ID NO: 1411 - protein, 8 aa, Unknown
  Resistance Marker For Multiple Organisms
EQAILLFR

SEQ ID NO: 1412 - protein, 8 aa, Unknown
  Resistance Marker For Multiple Organisms
EQIQFLLR

SEQ ID NO: 1413 - protein, 14 aa, Unknown
  Resistance Marker For Multiple Organisms
EQLAFDPQVQQQVK

SEQ ID NO: 1414 - protein, 8 aa, Unknown
  Resistance Marker For Multiple Organisms
EQVDFVQR

SEQ ID NO: 1415 - protein, 18 aa, Unknown
  Resistance Marker For Multiple Organisms
ETEVYFFAFNMDIDNESK

SEQ ID NO: 1416 - protein, 6 aa, Unknown
  Resistance Marker For Multiple Organisms
ETTTPR

SEQ ID NO: 1417 - protein, 6 aa, Unknown
  Resistance Marker For Multiple Organisms
EVGEIR

SEQ ID NO: 1418 - protein, 6 aa, Unknown
  Resistance Marker For Multiple Organisms
EVGEVR

SEQ ID NO: 1419 - protein, 6 aa, Unknown
  Resistance Marker For Multiple Organisms
EVNGSK

SEQ ID NO: 1420 - protein, 6 aa, Unknown
  Resistance Marker For Multiple Organisms
EWQENK

SEQ ID NO: 1421 - protein, 10 aa, Unknown
  Resistance Marker For Multiple Organisms
EYELYLNVWK

SEQ ID NO: 1422 - protein, 9 aa, Unknown
  Resistance Marker For Multiple Organisms
EYLPASTFK

SEQ ID NO: 1423 - protein, 9 aa, Unknown
  Resistance Marker For Multiple Organisms
EYLPVSTFK

SEQ ID NO: 1424 - protein, 14 aa, Unknown
  Resistance Marker For Multiple Organisms
EYNTSGTFVFYDGK

SEQ ID NO: 1425 - protein, 9 aa, Unknown
  Resistance Marker For Multiple Organisms
EYVPASTFK

SEQ ID NO: 1426 - protein, 21 aa, Unknown
  Resistance Marker For Multiple Organisms
FAAYVAGFGYGNGDISGEPGK

SEQ ID NO: 1427 - protein, 8 aa, Unknown
  Resistance Marker For Multiple Organisms
FAPESTFK

SEQ ID NO: 1428 - protein, 6 aa, Unknown
  Resistance Marker For Multiple Organisms
FAQYAK

SEQ ID NO: 1429 - protein, 6 aa, Unknown
  Resistance Marker For Multiple Organisms
FDYGNK

SEQ ID NO: 1430 - protein, 6 aa, Unknown
  Resistance Marker For Multiple Organisms
FDYGNR

SEQ ID NO: 1431 - protein, 6 aa, Unknown
  Resistance Marker For Multiple Organisms
FEDLYK

SEQ ID NO: 1432 - protein, 11 aa, Unknown
  Resistance Marker For Multiple Organisms
FEDTFHISNQK

SEQ ID NO: 1433 - protein, 14 aa, Unknown
  Resistance Marker For Multiple Organisms
FEDTFHTSNQQHEK

SEQ ID NO: 1434 - protein, 14 aa, Unknown
  Resistance Marker For Multiple Organisms
FEYGNQDVSGDSGK

SEQ ID NO: 1435 - protein, 8 aa, Unknown
  Resistance Marker For Multiple Organisms
FFSDFQAK

SEQ ID NO: 1436 - protein, 17 aa, Unknown
  Resistance Marker For Multiple Organisms
FFSDLQAEGAIVIADER

SEQ ID NO: 1437 - protein, 6 aa, Unknown
  Resistance Marker For Multiple Organisms
FFSDLR

SEQ ID NO: 1438 - protein, 8 aa, Unknown
  Resistance Marker For Multiple Organisms
FFSEFQAK

SEQ ID NO: 1439 - protein, 8 aa, Unknown
  Resistance Marker For Multiple Organisms
FGLEGQLR

SEQ ID NO: 1440 - protein, 21 aa, Unknown
  Resistance Marker For Multiple Organisms
FILPIFSISILVSLSACSSIK

SEQ ID NO: 1441 - protein, 20 aa, Unknown
  Resistance Marker For Multiple Organisms
FLALLFSAVVLVSLGHAQDK

SEQ ID NO: 1442 - protein, 20 aa, Unknown
  Resistance Marker For Multiple Organisms
FLALLFSAVVLVSLGHAQEK

SEQ ID NO: 1443 - protein, 14 aa, Unknown
  Resistance Marker For Multiple Organisms
FLESLYLNNLPASK

SEQ ID NO: 1444 - protein, 8 aa, Unknown
  Resistance Marker For Multiple Organisms
FLLEGQLR

SEQ ID NO: 1445 - protein, 7 aa, Unknown
  Resistance Marker For Multiple Organisms
FQQYVDR

SEQ ID NO: 1446 - protein, 7 aa, Unknown
  Resistance Marker For Multiple Organisms
FSDYVQR

SEQ ID NO: 1447 - protein, 8 aa, Unknown
  Resistance Marker For Multiple Organisms
FSTASTFK

SEQ ID NO: 1448 - protein, 6 aa, Unknown
  Resistance Marker For Multiple Organisms
FSWDGK

SEQ ID NO: 1449 - protein, 14 aa, Unknown
  Resistance Marker For Multiple Organisms
FSYGNQNISGGIDK

SEQ ID NO: 1450 - protein, 14 aa, Unknown
  Resistance Marker For Multiple Organisms
FSYGNQNISGGTDK

SEQ ID NO: 1451 - protein, 14 aa, Unknown
  Resistance Marker For Multiple Organisms
FSYGSQNISGGIDK

SEQ ID NO: 1452 - protein, 6 aa, Unknown
  Resistance Marker For Multiple Organisms
FTEYVK

SEQ ID NO: 1453 - protein, 5 aa, Unknown
  Resistance Marker For Multiple Organisms
FVAHK

SEQ ID NO: 1454 - protein, 8 aa, Unknown
  Resistance Marker For Multiple Organisms
FVPASTYK

SEQ ID NO: 1455 - protein, 13 aa, Unknown
  Resistance Marker For Multiple Organisms
FVYDLAQGQLPFK

SEQ ID NO: 1456 - protein, 21 aa, Unknown
  Resistance Marker For Multiple Organisms
FVYDLAQGQLPFKPEVQQQVK

SEQ ID NO: 1457 - protein, 8 aa, Unknown
  Resistance Marker For Multiple Organisms
FWLEDQLR

SEQ ID NO: 1458 - protein, 8 aa, Unknown
  Resistance Marker For Multiple Organisms
FWLEGPLK

SEQ ID NO: 1459 - protein, 8 aa, Unknown
  Resistance Marker For Multiple Organisms
FWLEGQLR

SEQ ID NO: 1460 - protein, 8 aa, Unknown
  Resistance Marker For Multiple Organisms
FYPASSFK

SEQ ID NO: 1461 - protein, 8 aa, Unknown
  Resistance Marker For Multiple Organisms
FYPASTFK

SEQ ID NO: 1462 - protein, 5 aa, Unknown
  Resistance Marker For Multiple Organisms
GACDK

SEQ ID NO: 1463 - protein, 18 aa, Unknown
  Resistance Marker For Multiple Organisms
GAEVYFFAFNMDIDNENK

SEQ ID NO: 1464 - protein, 16 aa, Unknown
  Resistance Marker For Multiple Organisms
GAIQVSAVPVFQQIAR

SEQ ID NO: 1465 - protein, 16 aa, Unknown
  Resistance Marker For Multiple Organisms
GAIQVSAVPVFQQITR

SEQ ID NO: 1466 - protein, 21 aa, Unknown
  Resistance Marker For Multiple Organisms
GDYWIDGNLEISAHEQISFLR

SEQ ID NO: 1467 - protein, 10 aa, Unknown
  Resistance Marker For Multiple Organisms
GDYWIDGNLK

SEQ ID NO: 1468 - protein, 14 aa, Unknown
  Resistance Marker For Multiple Organisms
GELPVSEDALEMTK

SEQ ID NO: 1469 - protein, 10 aa, Unknown
  Resistance Marker For Multiple Organisms
GEQPAGPAAR

SEQ ID NO: 1470 - protein, 12 aa, Unknown
  Resistance Marker For Multiple Organisms
GFAGHNQDQDLR

SEQ ID NO: 1471 - protein, 7 aa, Unknown
  Resistance Marker For Multiple Organisms
GIPSSVR

SEQ ID NO: 1472 - protein, 7 aa, Unknown
  Resistance Marker For Multiple Organisms
GISSSVR

SEQ ID NO: 1473 - protein, 12 aa, Unknown
  Resistance Marker For Multiple Organisms
GLNGTFVVYDLK

SEQ ID NO: 1474 - protein, 12 aa, Unknown
  Resistance Marker For Multiple Organisms
GMEIWNSNHTPK

SEQ ID NO: 1475 - protein, 9 aa, Unknown
  Resistance Marker For Multiple Organisms
GNQTLVFAR

SEQ ID NO: 1476 - protein, 21 aa, Unknown
  Resistance Marker For Multiple Organisms
GNYWIDGNLEISAHEQISFLR

SEQ ID NO: 1477 - protein, 12 aa, Unknown
  Resistance Marker For Multiple Organisms
GPLEISAFEEAR

SEQ ID NO: 1478 - protein, 12 aa, Unknown
  Resistance Marker For Multiple Organisms
GPLTITPIQEVK

SEQ ID NO: 1479 - protein, 11 aa, Unknown
  Resistance Marker For Multiple Organisms
GSGWFVGWIVR

SEQ ID NO: 1480 - protein, 9 aa, Unknown
  Resistance Marker For Multiple Organisms
GSLLLWDQK

SEQ ID NO: 1481 - protein, 18 aa, Unknown
  Resistance Marker For Multiple Organisms
GTEVYFFAFNMDIDNENK

SEQ ID NO: 1482 - protein, 18 aa, Unknown
  Resistance Marker For Multiple Organisms
GTEVYFFAFNMDIDNESK

SEQ ID NO: 1483 - protein, 10 aa, Unknown
  Resistance Marker For Multiple Organisms
GTFVLYDVQR

SEQ ID NO: 1484 - protein, 9 aa, Unknown
  Resistance Marker For Multiple Organisms
GTIVVADER

SEQ ID NO: 1485 - protein, 9 aa, Unknown
  Resistance Marker For Multiple Organisms
GTIVVLDAR

SEQ ID NO: 1486 - protein, 9 aa, Unknown
  Resistance Marker For Multiple Organisms
GTIVVVDER

SEQ ID NO: 1487 - protein, 8 aa, Unknown
  Resistance Marker For Multiple Organisms
GTLPFSAR

SEQ ID NO: 1488 - protein, 7 aa, Unknown
  Resistance Marker For Multiple Organisms
GTPSSVR

SEQ ID NO: 1489 - protein, 20 aa, Unknown
  Resistance Marker For Multiple Organisms
HALSSAFVLLGCIAASAHAK

SEQ ID NO: 1490 - protein, 6 aa, Unknown
  Resistance Marker For Multiple Organisms
HIADSK

SEQ ID NO: 1491 - protein, 14 aa, Unknown
  Resistance Marker For Multiple Organisms
HNGLTHAWLASSLK

SEQ ID NO: 1492 - protein, 18 aa, Unknown
  Resistance Marker For Multiple Organisms
HNGLTQSWLMSSLTISPK

SEQ ID NO: 1493 - protein, 14 aa, Unknown
  Resistance Marker For Multiple Organisms
HNGTDGAWIISSLR

SEQ ID NO: 1494 - protein, 10 aa, Unknown
  Resistance Marker For Multiple Organisms
HTLSVFDQER

SEQ ID NO: 1495 - protein, 8 aa, Unknown
  Resistance Marker For Multiple Organisms
HVTFASFR

SEQ ID NO: 1496 - protein, 14 aa, Unknown
  Resistance Marker For Multiple Organisms
IAISLMGYDAGFLR

SEQ ID NO: 1497 - protein, 16 aa, Unknown
  Resistance Marker For Multiple Organisms
IALSLMAFDAEIIDQK

SEQ ID NO: 1498 - protein, 14 aa, Unknown
  Resistance Marker For Multiple Organisms
IALSLMGFDSGILK

SEQ ID NO: 1499 - protein, 12 aa, Unknown
  Resistance Marker For Multiple Organisms
IANALIGLENHK

SEQ ID NO: 1500 - protein, 11 aa, Unknown
  Resistance Marker For Multiple Organisms
IAWIVGFVYLK

SEQ ID NO: 1501 - protein, 11 aa, Unknown
  Resistance Marker For Multiple Organisms
IDTFWLDNSLK

SEQ ID NO: 1502 - protein, 8 aa, Unknown
  Resistance Marker For Multiple Organisms
IDYYNLDR

SEQ ID NO: 1503 - protein, 14 aa, Unknown
  Resistance Marker For Multiple Organisms
IFNALIALDSGVIK

SEQ ID NO: 1504 - protein, 17 aa, Unknown
  Resistance Marker For Multiple Organisms
IFNSLLALDSGALDNER

SEQ ID NO: 1505 - protein, 14 aa, Unknown
  Resistance Marker For Multiple Organisms
IFNTLIGLENGIVK

SEQ ID NO: 1506 - protein, 8 aa, Unknown
  Resistance Marker For Multiple Organisms
IGLDLMQK

SEQ ID NO: 1507 - protein, 5 aa, Unknown
  Resistance Marker For Multiple Organisms
IGLEK

SEQ ID NO: 1508 - protein, 12 aa, Unknown
  Resistance Marker For Multiple Organisms
IGLELMQQEVQR

SEQ ID NO: 1509 - protein, 8 aa, Unknown
  Resistance Marker For Multiple Organisms
IGLELMSK

SEQ ID NO: 1510 - protein, 11 aa, Unknown
  Resistance Marker For Multiple Organisms
IGLELMSNEVK

SEQ ID NO: 1511 - protein, 5 aa, Unknown
  Resistance Marker For Multiple Organisms
IGLER

SEQ ID NO: 1512 - protein, 5 aa, Unknown
  Resistance Marker For Multiple Organisms
IGLNK

SEQ ID NO: 1513 - protein, 8 aa, Unknown
  Resistance Marker For Multiple Organisms
IGLNLMQK

SEQ ID NO: 1514 - protein, 12 aa, Unknown
  Resistance Marker For Multiple Organisms
IGPSLMQSELQR

SEQ ID NO: 1515 - protein, 18 aa, Unknown
  Resistance Marker For Multiple Organisms
IGYGNMQIGTEVDQFWLK

SEQ ID NO: 1516 - protein, 18 aa, Unknown
  Resistance Marker For Multiple Organisms
IGYGNMQMGTEVDQFWLK

SEQ ID NO: 1517 - protein, 9 aa, Unknown
  Resistance Marker For Multiple Organisms
IINHNLPVK

SEQ ID NO: 1518 - protein, 9 aa, Unknown
  Resistance Marker For Multiple Organisms
IINHNLPVR

SEQ ID NO: 1519 - protein, 14 aa, Unknown
  Resistance Marker For Multiple Organisms
ILFQQGTQQACAER

SEQ ID NO: 1520 - protein, 7 aa, Unknown
  Resistance Marker For Multiple Organisms
ILNNWFK

SEQ ID NO: 1521 - protein, 11 aa, Unknown
  Resistance Marker For Multiple Organisms
ILNTLISLEEK

SEQ ID NO: 1522 - protein, 21 aa, Unknown
  Resistance Marker For Multiple Organisms
ILSLVCLSISIGACAEHSMSR

SEQ ID NO: 1523 - protein, 5 aa, Unknown
  Resistance Marker For Multiple Organisms
INESR

SEQ ID NO: 1524 - protein, 5 aa, Unknown
  Resistance Marker For Multiple Organisms
INIVK

SEQ ID NO: 1525 - protein, 10 aa, Unknown
  Resistance Marker For Multiple Organisms
INLYGNALSR

SEQ ID NO: 1526 - protein, 10 aa, Unknown
  Resistance Marker For Multiple Organisms
IPFSLNLEMK

SEQ ID NO: 1527 - protein, 14 aa, Unknown
  Resistance Marker For Multiple Organisms
IPHTLFALDADAVR

SEQ ID NO: 1528 - protein, 14 aa, Unknown
  Resistance Marker For Multiple Organisms
IPHTLFALDAGAAR

SEQ ID NO: 1529 - protein, 14 aa, Unknown
  Resistance Marker For Multiple Organisms
IPHTLFALDAGAVR

SEQ ID NO: 1530 - protein, 5 aa, Unknown
  Resistance Marker For Multiple Organisms
IPLGK

SEQ ID NO: 1531 - protein, 14 aa, Unknown
  Resistance Marker For Multiple Organisms
IPNAIIGLETGVIK

SEQ ID NO: 1532 - protein, 14 aa, Unknown
  Resistance Marker For Multiple Organisms
IPNALIGLETGAIK

SEQ ID NO: 1533 - protein, 14 aa, Unknown
  Resistance Marker For Multiple Organisms
IPNSLIAFDTGAVR

SEQ ID NO: 1534 - protein, 14 aa, Unknown
  Resistance Marker For Multiple Organisms
IPSAIIGLETGVIK

SEQ ID NO: 1535 - protein, 8 aa, Unknown
  Resistance Marker For Multiple Organisms
ISAFNQVK

SEQ ID NO: 1536 - protein, 11 aa, Unknown
  Resistance Marker For Multiple Organisms
ISAHEQILFLR

SEQ ID NO: 1537 - protein, 8 aa, Unknown
  Resistance Marker For Multiple Organisms
ISAMEQTR

SEQ ID NO: 1538 - protein, 8 aa, Unknown
  Resistance Marker For Multiple Organisms
ISAMEQVK

SEQ ID NO: 1539 - protein, 11 aa, Unknown
  Resistance Marker For Multiple Organisms
ISATEQVAFLR

SEQ ID NO: 1540 - protein, 11 aa, Unknown
  Resistance Marker For Multiple Organisms
ISATQQIAFLR

SEQ ID NO: 1541 - protein, 17 aa, Unknown
  Resistance Marker For Multiple Organisms
ISAVNQVEFLESLFLNK

SEQ ID NO: 1542 - protein, 17 aa, Unknown
  Resistance Marker For Multiple Organisms
ISAVNQVEFLESLYLNK

SEQ ID NO: 1543 - protein, 8 aa, Unknown
  Resistance Marker For Multiple Organisms
ISAVNQVK

SEQ ID NO: 1544 - protein, 11 aa, Unknown
  Resistance Marker For Multiple Organisms
ISPEEQIQFLR

SEQ ID NO: 1545 - protein, 8 aa, Unknown
  Resistance Marker For Multiple Organisms
ISPEEQVR

SEQ ID NO: 1546 - protein, 8 aa, Unknown
  Resistance Marker For Multiple Organisms
ISPEGQVR

SEQ ID NO: 1547 - protein, 11 aa, Unknown
  Resistance Marker For Multiple Organisms
ISPLEQLAFLR

SEQ ID NO: 1548 - protein, 11 aa, Unknown
  Resistance Marker For Multiple Organisms
ITAFQQVDFLR

SEQ ID NO: 1549 - protein, 16 aa, Unknown
  Resistance Marker For Multiple Organisms
ITLFLLFLNLVFGQDK

SEQ ID NO: 1550 - protein, 17 aa, Unknown
  Resistance Marker For Multiple Organisms
ITPIQEVNFADDFANNR

SEQ ID NO: 1551 - protein, 17 aa, Unknown
  Resistance Marker For Multiple Organisms
ITPIQEVNFADDLANNR

SEQ ID NO: 1552 - protein, 12 aa, Unknown
  Resistance Marker For Multiple Organisms
ITPQQEAQFAYK

SEQ ID NO: 1553 - protein, 12 aa, Unknown
  Resistance Marker For Multiple Organisms
ITPQQEAQFTYK

SEQ ID NO: 1554 - protein, 17 aa, Unknown
  Resistance Marker For Multiple Organisms
ITPVQEVNFADDLAHNR

SEQ ID NO: 1555 - protein, 7 aa, Unknown
  Resistance Marker For Multiple Organisms
IVAFALK

SEQ ID NO: 1556 - protein, 11 aa, Unknown
  Resistance Marker For Multiple Organisms
IVAFALNMEMR

SEQ ID NO: 1557 - protein, 16 aa, Unknown
  Resistance Marker For Multiple Organisms
IVESTTLADGTVVHGK

SEQ ID NO: 1558 - protein, 11 aa, Unknown
  Resistance Marker For Multiple Organisms
IYNSLIGLNEK

SEQ ID NO: 1559 - protein, 13 aa, Unknown
  Resistance Marker For Multiple Organisms
KPDIGWWVGWIER

SEQ ID NO: 1560 - protein, 10 aa, Unknown
  Resistance Marker For Multiple Organisms
LACATNNLAR

SEQ ID NO: 1561 - protein, 17 aa, Unknown
  Resistance Marker For Multiple Organisms
LAQGELPFPAPVQSTVR

SEQ ID NO: 1562 - protein, 14 aa, Unknown
  Resistance Marker For Multiple Organisms
LAQNELPYPIEIQK

SEQ ID NO: 1563 - protein, 14 aa, Unknown
  Resistance Marker For Multiple Organisms
LAQNELQYPIEIQK

SEQ ID NO: 1564 - protein, 6 aa, Unknown
  Resistance Marker For Multiple Organisms
LDFGNK

SEQ ID NO: 1565 - protein, 7 aa, Unknown
  Resistance Marker For Multiple Organisms
LDGSLNR

SEQ ID NO: 1566 - protein, 5 aa, Unknown
  Resistance Marker For Multiple Organisms
LEIGK

SEQ ID NO: 1567 - protein, 16 aa, Unknown
  Resistance Marker For Multiple Organisms
LEILQQALAELGLYPK

SEQ ID NO: 1568 - protein, 8 aa, Unknown
  Resistance Marker For Multiple Organisms
LENQEQVK

SEQ ID NO: 1569 - protein, 9 aa, Unknown
  Resistance Marker For Multiple Organisms
LETQEEVEK

SEQ ID NO: 1570 - protein, 8 aa, Unknown
  Resistance Marker For Multiple Organisms
LETQEEVK

SEQ ID NO: 1571 - protein, 8 aa, Unknown
  Resistance Marker For Multiple Organisms
LFAAEGVK

SEQ ID NO: 1572 - protein, 8 aa, Unknown
  Resistance Marker For Multiple Organisms
LFESAGVK

SEQ ID NO: 1573 - protein, 8 aa, Unknown
  Resistance Marker For Multiple Organisms
LFGAAGVK

SEQ ID NO: 1574 - protein, 7 aa, Unknown
  Resistance Marker For Multiple Organisms
LFPEWEK

SEQ ID NO: 1575 - protein, 5 aa, Unknown
  Resistance Marker For Multiple Organisms
LGESR

SEQ ID NO: 1576 - protein, 5 aa, Unknown
  Resistance Marker For Multiple Organisms
LGVDR

SEQ ID NO: 1577 - protein, 6 aa, Unknown
  Resistance Marker For Multiple Organisms
LHVSER

SEQ ID NO: 1578 - protein, 7 aa, Unknown
  Resistance Marker For Multiple Organisms
LHYGNAK

SEQ ID NO: 1579 - protein, 9 aa, Unknown
  Resistance Marker For Multiple Organisms
LLNLLSQSK

SEQ ID NO: 1580 - protein, 6 aa, Unknown
  Resistance Marker For Multiple Organisms
LLQDER

SEQ ID NO: 1581 - protein, 10 aa, Unknown
  Resistance Marker For Multiple Organisms
LLVQDGDCGR

SEQ ID NO: 1582 - protein, 9 aa, Unknown
  Resistance Marker For Multiple Organisms
LNEVGYGNR

SEQ ID NO: 1583 - protein, 11 aa, Unknown
  Resistance Marker For Multiple Organisms
LNYGNADPSTK

SEQ ID NO: 1584 - protein, 6 aa, Unknown
  Resistance Marker For Multiple Organisms
LNYGNK

SEQ ID NO: 1585 - protein, 5 aa, Unknown
  Resistance Marker For Multiple Organisms
LPASK

SEQ ID NO: 1586 - protein, 14 aa, Unknown
  Resistance Marker For Multiple Organisms
LPHTLFALDADAVR

SEQ ID NO: 1587 - protein, 14 aa, Unknown
  Resistance Marker For Multiple Organisms
LPHTLFALDAGAVR

SEQ ID NO: 1588 - protein, 17 aa, Unknown
  Resistance Marker For Multiple Organisms
LPLAIMGFDSGILQSPK

SEQ ID NO: 1589 - protein, 20 aa, Unknown
  Resistance Marker For Multiple Organisms
LPLAIMGYDADILLDATTPR

SEQ ID NO: 1590 - protein, 14 aa, Unknown
  Resistance Marker For Multiple Organisms
LPSSLIALETGAVR

SEQ ID NO: 1591 - protein, 16 aa, Unknown
  Resistance Marker For Multiple Organisms
LPVSAQTLQYTANILK

SEQ ID NO: 1592 - protein, 6 aa, Unknown
  Resistance Marker For Multiple Organisms
LPVSER

SEQ ID NO: 1593 - protein, 13 aa, Unknown
  Resistance Marker For Multiple Organisms
LPVSPTAVDMTER

SEQ ID NO: 1594 - protein, 5 aa, Unknown
  Resistance Marker For Multiple Organisms
LSASK

SEQ ID NO: 1595 - protein, 12 aa, Unknown
  Resistance Marker For Multiple Organisms
LSAVPIYQEVAR

SEQ ID NO: 1596 - protein, 12 aa, Unknown
  Resistance Marker For Multiple Organisms
LSAVPVYQELAR

SEQ ID NO: 1597 - protein, 17 aa, Unknown
  Resistance Marker For Multiple Organisms
LSCTLVIDEASGDLLHR

SEQ ID NO: 1598 - protein, 14 aa, Unknown
  Resistance Marker For Multiple Organisms
LSLQHGWFIGWIEK

SEQ ID NO: 1599 - protein, 17 aa, Unknown
  Resistance Marker For Multiple Organisms
LSQNSLPFSQEAMNSVK

SEQ ID NO: 1600 - protein, 6 aa, Unknown
  Resistance Marker For Multiple Organisms
LSVNPK

SEQ ID NO: 1601 - protein, 6 aa, Unknown
  Resistance Marker For Multiple Organisms
LTQDER

SEQ ID NO: 1602 - protein, 6 aa, Unknown
  Resistance Marker For Multiple Organisms
LTVGAR

SEQ ID NO: 1603 - protein, 19 aa, Unknown
  Resistance Marker For Multiple Organisms
LYGFALNIDMPGGEADIGK

SEQ ID NO: 1604 - protein, 9 aa, Unknown
  Resistance Marker For Multiple Organisms
LYHNELPFR

SEQ ID NO: 1605 - protein, 5 aa, Unknown
  Resistance Marker For Multiple Organisms
LYHNK

SEQ ID NO: 1606 - protein, 9 aa, Unknown
  Resistance Marker For Multiple Organisms
LYQNDLPFR

SEQ ID NO: 1607 - protein, 6 aa, Unknown
  Resistance Marker For Multiple Organisms
MDDLFK

SEQ ID NO: 1608 - protein, 6 aa, Unknown
  Resistance Marker For Multiple Organisms
MEDLHK

SEQ ID NO: 1609 - protein, 12 aa, Unknown
  Resistance Marker For Multiple Organisms
MLIALIGLENHK

SEQ ID NO: 1610 - protein, 15 aa, Unknown
  Resistance Marker For Multiple Organisms
MLLIEQQGDAALYAK

SEQ ID NO: 1611 - protein, 5 aa, Unknown
  Resistance Marker For Multiple Organisms
MLLIK

SEQ ID NO: 1612 - protein, 12 aa, Unknown
  Resistance Marker For Multiple Organisms
MLNALIGLEHHK

SEQ ID NO: 1613 - protein, 12 aa, Unknown
  Resistance Marker For Multiple Organisms
MLNALIGLENHK

SEQ ID NO: 1614 - protein, 12 aa, Unknown
  Resistance Marker For Multiple Organisms
MLNALIGLENQK

SEQ ID NO: 1615 - protein, 12 aa, Unknown
  Resistance Marker For Multiple Organisms
MLNALIGLEYHK

SEQ ID NO: 1616 - protein, 12 aa, Unknown
  Resistance Marker For Multiple Organisms
MLNALIGLQHGK

SEQ ID NO: 1617 - protein, 12 aa, Unknown
  Resistance Marker For Multiple Organisms
MLNALISLEHHK

SEQ ID NO: 1618 - protein, 13 aa, Unknown
  Resistance Marker For Multiple Organisms
MQAYVDAFDYGNR

SEQ ID NO: 1619 - protein, 7 aa, Unknown
  Resistance Marker For Multiple Organisms
MQEGLNK

SEQ ID NO: 1620 - protein, 8 aa, Unknown
  Resistance Marker For Multiple Organisms
MSPASTYK

SEQ ID NO: 1621 - protein, 6 aa, Unknown
  Resistance Marker For Multiple Organisms
MTAGGK

SEQ ID NO: 1622 - protein, 5 aa, Unknown
  Resistance Marker For Multiple Organisms
MVSGK

SEQ ID NO: 1623 - protein, 10 aa, Unknown
  Resistance Marker For Multiple Organisms
NEHDPVLPYR

SEQ ID NO: 1624 - protein, 7 aa, Unknown
  Resistance Marker For Multiple Organisms
NEHQIFK

SEQ ID NO: 1625 - protein, 7 aa, Unknown
  Resistance Marker For Multiple Organisms
NEHQVFK

SEQ ID NO: 1626 - protein, 6 aa, Unknown
  Resistance Marker For Multiple Organisms
NEITYK

SEQ ID NO: 1627 - protein, 6 aa, Unknown
  Resistance Marker For Multiple Organisms
NELLMK

SEQ ID NO: 1628 - protein, 6 aa, Unknown
  Resistance Marker For Multiple Organisms
NELMMK

SEQ ID NO: 1629 - protein, 6 aa, Unknown
  Resistance Marker For Multiple Organisms
NELPFR

SEQ ID NO: 1630 - protein, 15 aa, Unknown
  Resistance Marker For Multiple Organisms
NFILIFIFVILISCK

SEQ ID NO: 1631 - protein, 15 aa, Unknown
  Resistance Marker For Multiple Organisms
NFILIFIFVILTSCK

SEQ ID NO: 1632 - protein, 11 aa, Unknown
  Resistance Marker For Multiple Organisms
NISSYGNNLVR

SEQ ID NO: 1633 - protein, 11 aa, Unknown
  Resistance Marker For Multiple Organisms
NISTYGNNLTR

SEQ ID NO: 1634 - protein, 15 aa, Unknown
  Resistance Marker For Multiple Organisms
NLFNEVHTTGVLVIR

SEQ ID NO: 1635 - protein, 11 aa, Unknown
  Resistance Marker For Multiple Organisms
NLSTYGNALAR

SEQ ID NO: 1636 - protein, 10 aa, Unknown
  Resistance Marker For Multiple Organisms
NMENLELFGK

SEQ ID NO: 1637 - protein, 12 aa, Unknown
  Resistance Marker For Multiple Organisms
NMLLLEENNGYK

SEQ ID NO: 1638 - protein, 12 aa, Unknown
  Resistance Marker For Multiple Organisms
NMLLLEESNGYK

SEQ ID NO: 1639 - protein, 7 aa, Unknown
  Resistance Marker For Multiple Organisms
NMLLLEK

SEQ ID NO: 1640 - protein, 9 aa, Unknown
  Resistance Marker For Multiple Organisms
NMTLGDAMK

SEQ ID NO: 1641 - protein, 14 aa, Unknown
  Resistance Marker For Multiple Organisms
NNGLTEAWLESSLK

SEQ ID NO: 1642 - protein, 6 aa, Unknown
  Resistance Marker For Multiple Organisms
NQLPFK

SEQ ID NO: 1643 - protein, 11 aa, Unknown
  Resistance Marker For Multiple Organisms
NQLPFQVEHQR

SEQ ID NO: 1644 - protein, 21 aa, Unknown
  Resistance Marker For Multiple Organisms
NSAIENTIDNMYLQDLENSTK

SEQ ID NO: 1645 - protein, 21 aa, Unknown
  Resistance Marker For Multiple Organisms
NSAIENTIENMYLQDLDNSTK

SEQ ID NO: 1646 - protein, 21 aa, Unknown
  Resistance Marker For Multiple Organisms
NSAIENTIENMYLQDLENSTK

SEQ ID NO: 1647 - protein, 12 aa, Unknown
  Resistance Marker For Multiple Organisms
NSAVWVYELFAK

SEQ ID NO: 1648 - protein, 8 aa, Unknown
  Resistance Marker For Multiple Organisms
NSQVPAYK

SEQ ID NO: 1649 - protein, 12 aa, Unknown
  Resistance Marker For Multiple Organisms
NSTVWIYELFAK

SEQ ID NO: 1650 - protein, 12 aa, Unknown
  Resistance Marker For Multiple Organisms
NSTVWVYELFAK

SEQ ID NO: 1651 - protein, 12 aa, Unknown
  Resistance Marker For Multiple Organisms
NSTVWVYQLFAK

SEQ ID NO: 1652 - protein, 12 aa, Unknown
  Resistance Marker For Multiple Organisms
NTSGALVIQTDK

SEQ ID NO: 1653 - protein, 12 aa, Unknown
  Resistance Marker For Multiple Organisms
NTSGVLVIQTDK

SEQ ID NO: 1654 - protein, 13 aa, Unknown
  Resistance Marker For Multiple Organisms
NVDEMFYYYDGSK

SEQ ID NO: 1655 - protein, 5 aa, Unknown
  Resistance Marker For Multiple Organisms
NWILR

SEQ ID NO: 1656 - protein, 9 aa, Unknown
  Resistance Marker For Multiple Organisms
NWNAAMDLR

SEQ ID NO: 1657 - protein, 17 aa, Unknown
  Resistance Marker For Multiple Organisms
NYVDAFHYGNQDISGDK

SEQ ID NO: 1658 - protein, 13 aa, Unknown
  Resistance Marker For Multiple Organisms
QADHAILVFDQAR

SEQ ID NO: 1659 - protein, 13 aa, Unknown
  Resistance Marker For Multiple Organisms
QAEHALLVFGQER

SEQ ID NO: 1660 - protein, 5 aa, Unknown
  Resistance Marker For Multiple Organisms
QAITK

SEQ ID NO: 1661 - protein, 14 aa, Unknown
  Resistance Marker For Multiple Organisms
QAMLTEANSDYIIR

SEQ ID NO: 1662 - protein, 11 aa, Unknown
  Resistance Marker For Multiple Organisms
QEVQFVSALAR

SEQ ID NO: 1663 - protein, 6 aa, Unknown
  Resistance Marker For Multiple Organisms
QFASIK

SEQ ID NO: 1664 - protein, 8 aa, Unknown
  Resistance Marker For Multiple Organisms
QGMPGSIR

SEQ ID NO: 1665 - protein, 8 aa, Unknown
  Resistance Marker For Multiple Organisms
QGMSGSIR

SEQ ID NO: 1666 - protein, 14 aa, Unknown
  Resistance Marker For Multiple Organisms
QGQTQQSYGNDLAR

SEQ ID NO: 1667 - protein, 13 aa, Unknown
  Resistance Marker For Multiple Organisms
QIDYGNADPSTIK

SEQ ID NO: 1668 - protein, 13 aa, Unknown
  Resistance Marker For Multiple Organisms
QIDYGNVDPSTIK

SEQ ID NO: 1669 - protein, 6 aa, Unknown
  Resistance Marker For Multiple Organisms
QIGEAR

SEQ ID NO: 1670 - protein, 6 aa, Unknown
  Resistance Marker For Multiple Organisms
QIGQAR

SEQ ID NO: 1671 - protein, 14 aa, Unknown
  Resistance Marker For Multiple Organisms
QIMLIEQTPAFTLR

SEQ ID NO: 1672 - protein, 12 aa, Unknown
  Resistance Marker For Multiple Organisms
QLGSAIDQFWLR

SEQ ID NO: 1673 - protein, 6 aa, Unknown
  Resistance Marker For Multiple Organisms
QLHDNK

SEQ ID NO: 1674 - protein, 11 aa, Unknown
  Resistance Marker For Multiple Organisms
QLIFVHTVVQK

SEQ ID NO: 1675 - protein, 14 aa, Unknown
  Resistance Marker For Multiple Organisms
QLIFVHTVVQKPGK

SEQ ID NO: 1676 - protein, 5 aa, Unknown
  Resistance Marker For Multiple Organisms
QLPVK

SEQ ID NO: 1677 - protein, 7 aa, Unknown
  Resistance Marker For Multiple Organisms
QLPVKPR

SEQ ID NO: 1678 - protein, 9 aa, Unknown
  Resistance Marker For Multiple Organisms
QLSLDVLDK

SEQ ID NO: 1679 - protein, 6 aa, Unknown
  Resistance Marker For Multiple Organisms
QLVYAR

SEQ ID NO: 1680 - protein, 14 aa, Unknown
  Resistance Marker For Multiple Organisms
QMMLTEASTDYIIR

SEQ ID NO: 1681 - protein, 16 aa, Unknown
  Resistance Marker For Multiple Organisms
QMSIVEATPDYVLHGK

SEQ ID NO: 1682 - protein, 7 aa, Unknown
  Resistance Marker For Multiple Organisms
QPTDPAR

SEQ ID NO: 1683 - protein, 7 aa, Unknown
  Resistance Marker For Multiple Organisms
QPTDPTR

SEQ ID NO: 1684 - protein, 8 aa, Unknown
  Resistance Marker For Multiple Organisms
QPVSAGIR

SEQ ID NO: 1685 - protein, 5 aa, Unknown
  Resistance Marker For Multiple Organisms
QQLVK

SEQ ID NO: 1686 - protein, 7 aa, Unknown
  Resistance Marker For Multiple Organisms
QTLVFAR

SEQ ID NO: 1687 - protein, 6 aa, Unknown
  Resistance Marker For Multiple Organisms
QVGAEK

SEQ ID NO: 1688 - protein, 6 aa, Unknown
  Resistance Marker For Multiple Organisms
QVVFAR

SEQ ID NO: 1689 - protein, 11 aa, Unknown
  Resistance Marker For Multiple Organisms
SADEVLPYGGK

SEQ ID NO: 1690 - protein, 14 aa, Unknown
  Resistance Marker For Multiple Organisms
SADEVLPYGGKPQR

SEQ ID NO: 1691 - protein, 9 aa, Unknown
  Resistance Marker For Multiple Organisms
SCATNDLAR

SEQ ID NO: 1692 - protein, 9 aa, Unknown
  Resistance Marker For Multiple Organisms
SCATNNLAR

SEQ ID NO: 1693 - protein, 8 aa, Unknown
  Resistance Marker For Multiple Organisms
SDIPGGSK

SEQ ID NO: 1694 - protein, 5 aa, Unknown
  Resistance Marker For Multiple Organisms
SDWGK

SEQ ID NO: 1695 - protein, 14 aa, Unknown
  Resistance Marker For Multiple Organisms
SEDNFHISSQQHEK

SEQ ID NO: 1696 - protein, 8 aa, Unknown
  Resistance Marker For Multiple Organisms
SEMPASIR

SEQ ID NO: 1697 - protein, 8 aa, Unknown
  Resistance Marker For Multiple Organisms
SEMPASTR

SEQ ID NO: 1698 - protein, 12 aa, Unknown
  Resistance Marker For Multiple Organisms
SFAAHNQDQDLR

SEQ ID NO: 1699 - protein, 7 aa, Unknown
  Resistance Marker For Multiple Organisms
SFAGHNK

SEQ ID NO: 1700 - protein, 12 aa, Unknown
  Resistance Marker For Multiple Organisms
SFAGHNQDQDLR

SEQ ID NO: 1701 - protein, 12 aa, Unknown
  Resistance Marker For Multiple Organisms
SFAGHNQDQNLR

SEQ ID NO: 1702 - protein, 8 aa, Unknown
  Resistance Marker For Multiple Organisms
SFLESWAK

SEQ ID NO: 1703 - protein, 7 aa, Unknown
  Resistance Marker For Multiple Organisms
SFTAWEK

SEQ ID NO: 1704 - protein, 7 aa, Unknown
  Resistance Marker For Multiple Organisms
SFTTWEK

SEQ ID NO: 1705 - protein, 7 aa, Unknown
  Resistance Marker For Multiple Organisms
SGSGWLR

SEQ ID NO: 1706 - protein, 20 aa, Unknown
  Resistance Marker For Multiple Organisms
SGWGMAVDPQVGWYVGFVEK

SEQ ID NO: 1707 - protein, 20 aa, Unknown
  Resistance Marker For Multiple Organisms
SGWGMDVSPQVGWLTGWVEK

SEQ ID NO: 1708 - protein, 20 aa, Unknown
  Resistance Marker For Multiple Organisms
SGWGMDVTPQVGWLTGWVEK

SEQ ID NO: 1709 - protein, 9 aa, Unknown
  Resistance Marker For Multiple Organisms
SIHPASTFK

SEQ ID NO: 1710 - protein, 5 aa, Unknown
  Resistance Marker For Multiple Organisms
SIPTK

SEQ ID NO: 1711 - protein, 5 aa, Unknown
  Resistance Marker For Multiple Organisms
SISTK

SEQ ID NO: 1712 - protein, 10 aa, Unknown
  Resistance Marker For Multiple Organisms
SLGLSNNLSR

SEQ ID NO: 1713 - protein, 7 aa, Unknown
  Resistance Marker For Multiple Organisms
SLSMSGK

SEQ ID NO: 1714 - protein, 8 aa, Unknown
  Resistance Marker For Multiple Organisms
SMLFIEEK

SEQ ID NO: 1715 - protein, 5 aa, Unknown
  Resistance Marker For Multiple Organisms
SNGEK

SEQ ID NO: 1716 - protein, 14 aa, Unknown
  Resistance Marker For Multiple Organisms
SNGLTHSWLGSSLK

SEQ ID NO: 1717 - protein, 5 aa, Unknown
  Resistance Marker For Multiple Organisms
SNGYK

SEQ ID NO: 1718 - protein, 7 aa, Unknown
  Resistance Marker For Multiple Organisms
SPTWELK

SEQ ID NO: 1719 - protein, 15 aa, Unknown
  Resistance Marker For Multiple Organisms
SPTWELKPEYNPSPR

SEQ ID NO: 1720 - protein, 6 aa, Unknown
  Resistance Marker For Multiple Organisms
SQDIVR

SEQ ID NO: 1721 - protein, 13 aa, Unknown
  Resistance Marker For Multiple Organisms
SQQKPTDPTIWLK

SEQ ID NO: 1722 - protein, 16 aa, Unknown
  Resistance Marker For Multiple Organisms
SQVGWLTGWVEQPDGK

SEQ ID NO: 1723 - protein, 13 aa, Unknown
  Resistance Marker For Multiple Organisms
SSSNSCTTNNAAR

SEQ ID NO: 1724 - protein, 13 aa, Unknown
  Resistance Marker For Multiple Organisms
SSSNSCTTNNATR

SEQ ID NO: 1725 - protein, 7 aa, Unknown
  Resistance Marker For Multiple Organisms
SVYGELR

SEQ ID NO: 1726 - protein, 5 aa, Unknown
  Resistance Marker For Multiple Organisms
SWILR

SEQ ID NO: 1727 - protein, 15 aa, Unknown
  Resistance Marker For Multiple Organisms
SYFDEAQTQGVIIIK

SEQ ID NO: 1728 - protein, 5 aa, Unknown
  Resistance Marker For Multiple Organisms
SYLEK

SEQ ID NO: 1729 - protein, 7 aa, Unknown
  Resistance Marker For Multiple Organisms
SYPMWEK

SEQ ID NO: 1730 - protein, 10 aa, Unknown
  Resistance Marker For Multiple Organisms
TAYIPASTFK

SEQ ID NO: 1731 - protein, 6 aa, Unknown
  Resistance Marker For Multiple Organisms
TDDLFK

SEQ ID NO: 1732 - protein, 8 aa, Unknown
  Resistance Marker For Multiple Organisms
TDINEIFK

SEQ ID NO: 1733 - protein, 8 aa, Unknown
  Resistance Marker For Multiple Organisms
TFIHNDPR

SEQ ID NO: 1734 - protein, 9 aa, Unknown
  Resistance Marker For Multiple Organisms
TGAGFTANR

SEQ ID NO: 1735 - protein, 8 aa, Unknown
  Resistance Marker For Multiple Organisms
TGFNDGQK

SEQ ID NO: 1736 - protein, 7 aa, Unknown
  Resistance Marker For Multiple Organisms
TGLADSK

SEQ ID NO: 1737 - protein, 8 aa, Unknown
  Resistance Marker For Multiple Organisms
TGLDLMQK

SEQ ID NO: 1738 - protein, 8 aa, Unknown
  Resistance Marker For Multiple Organisms
TGLELMQK

SEQ ID NO: 1739 - protein, 7 aa, Unknown
  Resistance Marker For Multiple Organisms
TGMGYPK

SEQ ID NO: 1740 - protein, 5 aa, Unknown
  Resistance Marker For Multiple Organisms
TGNGR

SEQ ID NO: 1741 - protein, 10 aa, Unknown
  Resistance Marker For Multiple Organisms
TGTGSFIDAR

SEQ ID NO: 1742 - protein, 10 aa, Unknown
  Resistance Marker For Multiple Organisms
TGTGSLSDAK

SEQ ID NO: 1743 - protein, 20 aa, Unknown
  Resistance Marker For Multiple Organisms
TGVATEYQPEIGWWAGWVER

SEQ ID NO: 1744 - protein, 13 aa, Unknown
  Resistance Marker For Multiple Organisms
TGVSYPLLADGTR

SEQ ID NO: 1745 - protein, 9 aa, Unknown
  Resistance Marker For Multiple Organisms
TGWAAMDIK

SEQ ID NO: 1746 - protein, 8 aa, Unknown
  Resistance Marker For Multiple Organisms
TGWAMDIK

SEQ ID NO: 1747 - protein, 8 aa, Unknown
  Resistance Marker For Multiple Organisms
TGWAMDVK

SEQ ID NO: 1748 - protein, 6 aa, Unknown
  Resistance Marker For Multiple Organisms
TGWATR

SEQ ID NO: 1749 - protein, 19 aa, Unknown
  Resistance Marker For Multiple Organisms
TGWCFDCTPELGWWVGWVK

SEQ ID NO: 1750 - protein, 6 aa, Unknown
  Resistance Marker For Multiple Organisms
TGWEGR

SEQ ID NO: 1751 - protein, 7 aa, Unknown
  Resistance Marker For Multiple Organisms
TGWFVDK

SEQ ID NO: 1752 - protein, 6 aa, Unknown
  Resistance Marker For Multiple Organisms
TGYDTK

SEQ ID NO: 1753 - protein, 6 aa, Unknown
  Resistance Marker For Multiple Organisms
TGYGVR

SEQ ID NO: 1754 - protein, 6 aa, Unknown
  Resistance Marker For Multiple Organisms
TGYSAR

SEQ ID NO: 1755 - protein, 6 aa, Unknown
  Resistance Marker For Multiple Organisms
TGYSTR

SEQ ID NO: 1756 - protein, 9 aa, Unknown
  Resistance Marker For Multiple Organisms
THESSNWGK

SEQ ID NO: 1757 - protein, 13 aa, Unknown
  Resistance Marker For Multiple Organisms
TICTAIADAGTGK

SEQ ID NO: 1758 - protein, 20 aa, Unknown
  Resistance Marker For Multiple Organisms
TIGGAPDAYWVDDSLQISAR

SEQ ID NO: 1759 - protein, 13 aa, Unknown
  Resistance Marker For Multiple Organisms
TLPFSASSYETLR

SEQ ID NO: 1760 - protein, 7 aa, Unknown
  Resistance Marker For Multiple Organisms
TLPFSLK

SEQ ID NO: 1761 - protein, 7 aa, Unknown
  Resistance Marker For Multiple Organisms
TLPFSPK

SEQ ID NO: 1762 - protein, 21 aa, Unknown
  Resistance Marker For Multiple Organisms
TLPFSQEVQDEVQSILFIEEK

SEQ ID NO: 1763 - protein, 21 aa, Unknown
  Resistance Marker For Multiple Organisms
TLPFSQEVQDEVQSMLFIEEK

SEQ ID NO: 1764 - protein, 7 aa, Unknown
  Resistance Marker For Multiple Organisms
TLPFSQK

SEQ ID NO: 1765 - protein, 7 aa, Unknown
  Resistance Marker For Multiple Organisms
TLPSSQK

SEQ ID NO: 1766 - protein, 14 aa, Unknown
  Resistance Marker For Multiple Organisms
TLQNGWFEGFIISK

SEQ ID NO: 1767 - protein, 8 aa, Unknown
  Resistance Marker For Multiple Organisms
TMQEYLNK

SEQ ID NO: 1768 - protein, 13 aa, Unknown
  Resistance Marker For Multiple Organisms
TNGNSTSVYNESR

SEQ ID NO: 1769 - protein, 11 aa, Unknown
  Resistance Marker For Multiple Organisms
TQTYQAYDAAR

SEQ ID NO: 1770 - protein, 9 aa, Unknown
  Resistance Marker For Multiple Organisms
TTDPTIWEK

SEQ ID NO: 1771 - protein, 8 aa, Unknown
  Resistance Marker For Multiple Organisms
TTTTEVFK

SEQ ID NO: 1772 - protein, 9 aa, Unknown
  Resistance Marker For Multiple Organisms
TWASNDFSR

SEQ ID NO: 1773 - protein, 7 aa, Unknown
  Resistance Marker For Multiple Organisms
TWDMVQR

SEQ ID NO: 1774 - protein, 17 aa, Unknown
  Resistance Marker For Multiple Organisms
TWMQFSVVWVSQEITQK

SEQ ID NO: 1775 - protein, 7 aa, Unknown
  Resistance Marker For Multiple Organisms
TYPMWEK

SEQ ID NO: 1776 - protein, 8 aa, Unknown
  Resistance Marker For Multiple Organisms
TYVVDPAR

SEQ ID NO: 1777 - protein, 10 aa, Unknown
  Resistance Marker For Multiple Organisms
VAFSLNIEMK

SEQ ID NO: 1778 - protein, 14 aa, Unknown
  Resistance Marker For Multiple Organisms
VANSLIGLSTGAVR

SEQ ID NO: 1779 - protein, 5 aa, Unknown
  Resistance Marker For Multiple Organisms
VEHQR

SEQ ID NO: 1780 - protein, 5 aa, Unknown
  Resistance Marker For Multiple Organisms
VELGK

SEQ ID NO: 1781 - protein, 20 aa, Unknown
  Resistance Marker For Multiple Organisms
VFDDAGVSGTFVLMDITADR

SEQ ID NO: 1782 - protein, 8 aa, Unknown
  Resistance Marker For Multiple Organisms
VFLDSWAK

SEQ ID NO: 1783 - protein, 8 aa, Unknown
  Resistance Marker For Multiple Organisms
VFLESWAK

SEQ ID NO: 1784 - protein, 17 aa, Unknown
  Resistance Marker For Multiple Organisms
VFLSSWAQDMNLSSAIK

SEQ ID NO: 1785 - protein, 5 aa, Unknown
  Resistance Marker For Multiple Organisms
VGFER

SEQ ID NO: 1786 - protein, 9 aa, Unknown
  Resistance Marker For Multiple Organisms
VILVFDQVR

SEQ ID NO: 1787 - protein, 6 aa, Unknown
  Resistance Marker For Multiple Organisms
VITFTK

SEQ ID NO: 1788 - protein, 7 aa, Unknown
  Resistance Marker For Multiple Organisms
VMAAMVR

SEQ ID NO: 1789 - protein, 20 aa, Unknown
  Resistance Marker For Multiple Organisms
VPLAVMGYDAGILVDAHNPR

SEQ ID NO: 1790 - protein, 6 aa, Unknown
  Resistance Marker For Multiple Organisms
VQANVK

SEQ ID NO: 1791 - protein, 6 aa, Unknown
  Resistance Marker For Multiple Organisms
VQDEVK

SEQ ID NO: 1792 - protein, 14 aa, Unknown
  Resistance Marker For Multiple Organisms
VQDEVQSMLFIEEK

SEQ ID NO: 1793 - protein, 18 aa, Unknown
  Resistance Marker For Multiple Organisms
VQDEVQSMLFIEEMNGNK

SEQ ID NO: 1794 - protein, 14 aa, Unknown
  Resistance Marker For Multiple Organisms
VQDGVQSMLFIEEK

SEQ ID NO: 1795 - protein, 14 aa, Unknown
  Resistance Marker For Multiple Organisms
VQHEVQSMLFIEEK

SEQ ID NO: 1796 - protein, 13 aa, Unknown
  Resistance Marker For Multiple Organisms
VSCLPCYQVVSHK

SEQ ID NO: 1797 - protein, 12 aa, Unknown
  Resistance Marker For Multiple Organisms
VSCVWCYQALAR

SEQ ID NO: 1798 - protein, 17 aa, Unknown
  Resistance Marker For Multiple Organisms
VSDVCSEVTAEGWQEVR

SEQ ID NO: 1799 - protein, 12 aa, Unknown
  Resistance Marker For Multiple Organisms
VSEVEGWQIHGK

SEQ ID NO: 1800 - protein, 10 aa, Unknown
  Resistance Marker For Multiple Organisms
VSFSLNIEMK

SEQ ID NO: 1801 - protein, 8 aa, Unknown
  Resistance Marker For Multiple Organisms
VSPCSSFK

SEQ ID NO: 1802 - protein, 8 aa, Unknown
  Resistance Marker For Multiple Organisms
VSQVPAYK

SEQ ID NO: 1803 - protein, 5 aa, Unknown
  Resistance Marker For Multiple Organisms
VVFAR

SEQ ID NO: 1804 - protein, 5 aa, Unknown
  Resistance Marker For Multiple Organisms
WDGAK

SEQ ID NO: 1805 - protein, 5 aa, Unknown
  Resistance Marker For Multiple Organisms
WDGEK

SEQ ID NO: 1806 - protein, 13 aa, Unknown
  Resistance Marker For Multiple Organisms
WDGHIYDFPDWNR

SEQ ID NO: 1807 - protein, 5 aa, Unknown
  Resistance Marker For Multiple Organisms
WDGIK

SEQ ID NO: 1808 - protein, 6 aa, Unknown
  Resistance Marker For Multiple Organisms
WDGKPR

SEQ ID NO: 1809 - protein, 5 aa, Unknown
  Resistance Marker For Multiple Organisms
WDGQK

SEQ ID NO: 1810 - protein, 6 aa, Unknown
  Resistance Marker For Multiple Organisms
WDGQTR

SEQ ID NO: 1811 - protein, 5 aa, Unknown
  Resistance Marker For Multiple Organisms
WDGVK

SEQ ID NO: 1812 - protein, 6 aa, Unknown
  Resistance Marker For Multiple Organisms
WDGVNR

SEQ ID NO: 1813 - protein, 11 aa, Unknown
  Resistance Marker For Multiple Organisms
WDYKPEFNGYK

SEQ ID NO: 1814 - protein, 21 aa, Unknown
  Resistance Marker For Multiple Organisms
WETYSVVWFSQQITEWLGMER

SEQ ID NO: 1815 - protein, 5 aa, Unknown
  Resistance Marker For Multiple Organisms
WNGQK

SEQ ID NO: 1816 - protein, 5 aa, Unknown
  Resistance Marker For Multiple Organisms
YAQAK

SEQ ID NO: 1817 - protein, 8 aa, Unknown
  Resistance Marker For Multiple Organisms
YFSDFNAK

SEQ ID NO: 1818 - protein, 7 aa, Unknown
  Resistance Marker For Multiple Organisms
YGTHLDR

SEQ ID NO: 1819 - protein, 6 aa, Unknown
  Resistance Marker For Multiple Organisms
YIIHNK

SEQ ID NO: 1820 - protein, 7 aa, Unknown
  Resistance Marker For Multiple Organisms
YLDELVK

SEQ ID NO: 1821 - protein, 9 aa, Unknown
  Resistance Marker For Multiple Organisms
YLMITEAGR

SEQ ID NO: 1822 - protein, 18 aa, Unknown
  Resistance Marker For Multiple Organisms
YLNLFSYGNANIGGGIDK

SEQ ID NO: 1823 - protein, 5 aa, Unknown
  Resistance Marker For Multiple Organisms
YNGEK

SEQ ID NO: 1824 - protein, 6 aa, Unknown
  Resistance Marker For Multiple Organisms
YPHNPR

SEQ ID NO: 1825 - protein, 18 aa, Unknown
  Resistance Marker For Multiple Organisms
YPVVWYSQQVAHHLGAQR

SEQ ID NO: 1826 - protein, 8 aa, Unknown
  Resistance Marker For Multiple Organisms
YSNVLAFK

SEQ ID NO: 1827 - protein, 8 aa, Unknown
  Resistance Marker For Multiple Organisms
YSPASTFK

SEQ ID NO: 1828 - protein, 12 aa, Unknown
  Resistance Marker For Multiple Organisms
YSVVPVYQQLAR

SEQ ID NO: 1829 - protein, 12 aa, Unknown
  Resistance Marker For Multiple Organisms
YSVVWYSQLTAK

SEQ ID NO: 1830 - protein, 18 aa, Unknown
  Resistance Marker For Multiple Organisms
YSVVWYSQQVAHHLGAQR

SEQ ID NO: 1831 - protein, 8 aa, Unknown
  Resistance Marker For Multiple Organisms
YTPASTFK

SEQ ID NO: 1832 - protein, 18 aa, Unknown
  Resistance Marker For Multiple Organisms
YTSAFGYGNADVSGEPGK

SEQ ID NO: 1833 - protein, 20 aa, Unknown
  Resistance Marker For Multiple Organisms
YVFVSALTGNLGSNLTSSIK

SEQ ID NO: 1834 - protein, 20 aa, Unknown
  Resistance Marker For Multiple Organisms
YVFVSALTGSLGSNLTSSIK

SEQ ID NO: 1835 - protein, 6 aa, Unknown
  Resistance Marker For Multiple Organisms
YVGHDR

SEQ ID NO: 1836 - protein, 286 aa, Unknown [sequence omitted]

SEQ ID NO: 1837 - protein, 286 aa, Unknown; identical to SEQ ID NO: 31
  Resistance Marker For Multiple Organisms

SEQ ID NO: 1838 - protein, 286 aa, Unknown; identical to SEQ ID NO: 2
  Resistance Marker For Multiple Organisms

SEQ ID NO: 1839 - protein, 286 aa, Unknown; identical to SEQ ID NO: 45
  Resistance Marker For Multiple Organisms

SEQ ID NO: 1840 - protein, 286 aa, Unknown; identical to SEQ ID NO: 46
  Resistance Marker For Multiple Organisms

SEQ ID NO: 1841 - protein, 286 aa, Unknown; identical to SEQ ID NO: 47
  Resistance Marker For Multiple Organisms

SEQ ID NO: 1842 - protein, 286 aa, Unknown; identical to SEQ ID NO: 27
  Resistance Marker For Multiple Organisms

SEQ ID NO: 1843 - protein, 286 aa, Unknown; identical to SEQ ID NO: 28
  Resistance Marker For Multiple Organisms

SEQ ID NO: 1844 - protein, 382 aa, Unknown; identical to SEQ ID NO: 263
  Resistance Marker For Multiple Organisms

SEQ ID NO: 1845 - protein, 382 aa, Unknown; identical to SEQ ID NO: 264
  Resistance Marker For Multiple Organisms

SEQ ID NO: 1846 - protein, 381 aa, Unknown; identical to SEQ ID NO: 266
  Resistance Marker For Multiple Organisms

SEQ ID NO: 1847 - protein, 383 aa, Unknown; identical to SEQ ID NO: 267
  Resistance Marker For Multiple Organisms

SEQ ID NO: 1848 - protein, 381 aa, Unknown; identical to SEQ ID NO: 270
  Resistance Marker For Multiple Organisms

SEQ ID NO: 1849 - protein, 381 aa, Unknown; identical to SEQ ID NO: 275
  Resistance Marker For Multiple Organisms

SEQ ID NO: 1850 - protein, 379 aa, Unknown; identical to SEQ ID NO: 284
  Resistance Marker For Multiple Organisms

SEQ ID NO: 1851 - protein, 377 aa, Unknown; identical to SEQ ID NO: 286
  Resistance Marker For Multiple Organisms

SEQ ID NO: 1852 - protein, 381 aa, Unknown
  Resistance Marker For Multiple Organisms
MMKKSLCCALLLTASFSTFAAAKTEQQIADIVNRTITPLMQEQAIPGMAVAVLYQGKPYYFTWGKADIANNHPVTQQTLFELGSVSKTFNGVLGGDAIARGEIKLSDPVTKYLPELTGKQWQGISLLHLATYTAGGLPLQIPDDVTDKAALLRFYQNWQPQWTPGAKRLYANSSIGLFGALAVKPSGMSYEEAMTRRVLQPLKLAHTWITVPQNEQKDYAWGYREGKPVHVTPGQLDAEAYGVKSNVTDMARWIQVNMDASRVQEKTLQQGIALAQSRYWRIGDMYQGLGWEMLNWPLKADSIINGSDSKVALAALPTVEVNPPAPAVKASWVHKTGSTGGFGSYVAFVPEKNLGIVMLANKSYPNPVRVEAAWRILEKLQ

SEQ ID NO: 1853 - protein, 381 aa, Unknown
  Resistance Marker For Multiple Organisms
MMKKSICCALLLTASFSTFAAAKTEQQIADIVNRTITPLMQEQAIPGMAVAIIYEGKPYYFTWGKADIANNHPVTQQTLFELGSVSKTFNGVLGGDAIARGEIKLSDPVTKYWPELTGKQWRGISLLHLATYTAGGLPLQIPDDVTDKAALLRFYQNWQPQWTPGAKRLYANSSIGLFGALAVKPSGMSYEEAMTRRVLQPLKLAHTWITVPQSEQKNYAWGYREGKPVHVSPGQLDAEAYGVKSSVIDMARWVQANMDASHVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPARVEAAWRILEKLQ

SEQ ID NO: 1854 - protein, 381 aa, Unknown; identical to SEQ ID NO: 292
  Resistance Marker For Multiple Organisms

SEQ ID NO: 1855 - protein, 381 aa, Unknown
  Resistance Marker For Multiple Organisms
MMKKSLCCALLLTASLSTFAAAKTEQQIADIVNRTITPLMQEQAIPGMAIAVIYQGKPYYFTWGKADITNNHPVTQQTLFELGSVSKTFNGVLGGDAIARGEIKLSDPVTKYWPELTGKQWQGISLLHLATYTAGGLPLQIPDDVTDKAALLRFYQNWQPQWAPGAKRLYANSSIGLFGALAVKPSGMSYEEAMTRRVLQPLKLAHTWITVPQNEQKDYAWGYREGKAVHVSPGQLDAEAYGVKSSVIDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 1856 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYCVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 1857 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFIGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 1858 - protein, 380 aa, Unknown
  Resistance Marker For Multiple Organisms
MMNRYAAALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 1859 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFSALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 1860 - protein, 382 aa, Unknown; identical to SEQ ID NO: 293
  Resistance Marker For Multiple Organisms

SEQ ID NO: 1861 - protein, 382 aa, Unknown; identical to SEQ ID NO: 294
  Resistance Marker For Multiple Organisms

SEQ ID NO: 1862 - protein, 381 aa, Unknown; identical to SEQ ID NO: 300
  Resistance Marker For Multiple Organisms

SEQ ID NO: 1863 - protein, 382 aa, Unknown; identical to SEQ ID NO: 301
  Resistance Marker For Multiple Organisms

SEQ ID NO: 1864 - protein, 381 aa, Unknown; identical to SEQ ID NO: 302
  Resistance Marker For Multiple Organisms

SEQ ID NO: 1865 - protein, 381 aa, Unknown; identical to SEQ ID NO: 304
  Resistance Marker For Multiple Organisms

SEQ ID NO: 1866 - protein, 381 aa, Unknown; identical to SEQ ID NO: 305
  Resistance Marker For Multiple Organisms

SEQ ID NO: 1867 - protein, 381 aa, Unknown; identical to SEQ ID NO: 308
  Resistance Marker For Multiple Organisms

SEQ ID NO: 1868 - protein, 381 aa, Unknown; identical to SEQ ID NO: 309
  Resistance Marker For Multiple Organisms

SEQ ID NO: 1869 - protein, 381 aa, Unknown; identical to SEQ ID NO: 310
  Resistance Marker For Multiple Organisms

SEQ ID NO: 1870 - protein, 381 aa, Unknown
  Resistance Marker For Multiple Organisms
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLKIPDDVRDKAALLHFYQNWQPQWTPGAKRLYSNSSIGLFGALAVKPSGMSYEEAMTRRVLQPLKLAHTWITVPQNEQKDYARGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTVGFGSYVAFVPEKNLGIVMLANKSYPNPVRVEAAWRILEKLQ

SEQ ID NO: 1871 - protein, 291 aa, Unknown; identical to SEQ ID NO: 355
  Resistance Marker For Multiple Organisms

SEQ ID NO: 1872 - protein, 291 aa, Unknown; identical to SEQ ID NO: 361
  Resistance Marker For Multiple Organisms

SEQ ID NO: 1873 - protein, 291 aa, Unknown; identical to SEQ ID NO: 362
  Resistance Marker For Multiple Organisms

SEQ ID NO: 1874 - protein, 291 aa, Unknown; identical to SEQ ID NO: 363
  Resistance Marker For Multiple Organisms

SEQ ID NO: 1875 - protein, 291 aa, Unknown; identical to SEQ ID NO: 364
  Resistance Marker For Multiple Organisms

SEQ ID NO: 1876 - protein, 291 aa, Unknown; identical to SEQ ID NO: 367
  Resistance Marker For Multiple Organisms

SEQ ID NO: 1877 - protein, 290 aa, Unknown; identical to SEQ ID NO: 375
  Resistance Marker For Multiple Organisms

SEQ ID NO: 1878 - protein, 291 aa, Unknown; identical to SEQ ID NO: 393
  Resistance Marker For Multiple Organisms

SEQ ID NO: 1879 - protein, 291 aa, Unknown; identical to SEQ ID NO: 396
  Resistance Marker For Multiple Organisms

SEQ ID NO: 1880 - protein, 291 aa, Unknown; identical to SEQ ID NO: 397
  Resistance Marker For Multiple Organisms

SEQ ID NO: 1881 - protein, 291 aa, Unknown; identical to SEQ ID NO: 398
  Resistance Marker For Multiple Organisms

SEQ ID NO: 1882 - protein, 291 aa, Unknown; identical to SEQ ID NO: 399
  Resistance Marker For Multiple Organisms

SEQ ID NO: 1883 - protein, 291 aa, Unknown; identical to SEQ ID NO: 406
  Resistance Marker For Multiple Organisms

SEQ ID NO: 1884 - protein, 291 aa, Unknown; identical to SEQ ID NO: 412
  Resistance Marker For Multiple Organisms

SEQ ID NO: 1885 - protein, 291 aa, Unknown; identical to SEQ ID NO: 413
  Resistance Marker For Multiple Organisms

SEQ ID NO: 1886 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKAMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 1887 - protein, 291 aa, Unknown; identical to SEQ ID NO: 421
  Resistance Marker For Multiple Organisms

SEQ ID NO: 1888 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTQNTAIPGDPRDTTTPRAMAQTLRQLTLGHALGETQRAQLVTWLKGNTTGAASIRAGLPTSWTVGDKTGSGGYGTTNDIAVIWPQGRAPLVLVTYFTQPQQNAESRRDVLASAARIIAEGL

SEQ ID NO: 1889 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELIAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 1890 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQREQLVTWLKGNTTGAASIRAGLPTSWTVGDKTGSGGYGTTNDIAVIWPQGRAPLVLVTYFTQPQQNAESRRDVLASAARIIAEGL

SEQ ID NO: 1891 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAVAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQREQLVTWLKGNTTGAASIRAGLPTSWTVGDKTGSGGYGTTNDIAVIWPQGRAPLVLVTYFTQPQQNAESRRDVLASAARIIAEGL

SEQ ID NO: 1892 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAENRRDVLASAARIIAEGL

SEQ ID NO: 1893 - protein, 290 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDRTGSGDYGTTNDIAVIWPQGRAPLVLVTYFTQPQQNAESRHDVLASAARIIAEG

SEQ ID NO: 1894 - protein, 291 aa, Unknown
  Resistance Marker For Multiple Organisms
MVKKSLRQFTLMATATVTLLLGSVPLYAQTADVQQKLAELERQSGGRLGVALINTADNSQILYRADERFAMCSTSKVMAVAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGDYGTTNDIAVIWPKDRAPLILVTYFTQPQPKAESRRDVLASAAKIVTNGL

SEQ ID NO: 1895 - protein, 292 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEEHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGNL

SEQ ID NO: 1896 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELSAAALQYSDNTAMNKLIAQLGGQGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 1897 - protein, 287 aa, Unknown
  Resistance Marker For Multiple Organisms
VKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDRTGSGGYGTTNDIAVIWPKDRAPLILVTYFTQPQPKAESRRDVLASAAKIVT

SEQ ID NO: 1898 - protein, 287 aa, Unknown
  Resistance Marker For Multiple Organisms
VKKSLRQFTLMATATVTLLLGSVPLYAQTADVQQKLAELERQSGGRLGVALINTADNSQILYRADERFAMCSTSKVMAAAAVLKKSESEPNLLNQRAEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVT

SEQ ID NO: 1899 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKQSETQKQLLNQPVEIKPADLVNYNPIAEKHVNGTMTLAELGAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 1900 - protein, 291 aa, Unknown
  Resistance Marker For Multiple Organisms
MVTKRVQRMMFAAAACIPLLLGSAPLYAQTSAVQQKLAALEKSSGGRLGVALIDTADNTQVLYRGDERFPMCSTSKVMAAAAVLKRSETQKQLLNQPVEIKPADLVNYNPIAEKHVNGTMTLAELSAAALQYSDNTAMNKLIAQLGGPGGVTAFARAIGDETFRLDRTEPTLNTAIPGDPRDTTTPRAMAQTLRQLTLGHALGETQRAQLVTWLKGNTTGAASIRAGLPTSWTVGDKTGSGDYGTTNDIAVIWPQGRAPLVLVTYFTQPQQNAESRRDVLASAARIIAEGL

SEQ ID NO: 1901 - protein, 288 aa, Unknown
  Resistance Marker For Multiple Organisms
VKKSLRQFTLMATATVTLLLGSVPLYAQTADVQQKLAELERQSGGRLGVALINTADNSRILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTK

SEQ ID NO: 1902 - protein, 291 aa, Unknown; identical to SEQ ID NO: 424
  Resistance Marker For Multiple Organisms

SEQ ID NO: 1903 - protein, 290 aa, Unknown; identical to SEQ ID NO: 427
  Resistance Marker For Multiple Organisms

SEQ ID NO: 1904 - protein, 291 aa, Unknown; identical to SEQ ID NO: 431
  Resistance Marker For Multiple Organisms

SEQ ID NO: 1905 - protein, 291 aa, Unknown; identical to SEQ ID NO: 432
  Resistance Marker For Multiple Organisms

SEQ ID NO: 1906 - protein, 291 aa, Unknown; identical to SEQ ID NO: 433
  Resistance Marker For Multiple Organisms

SEQ ID NO: 1907 - protein, 291 aa, Unknown; identical to SEQ ID NO: 435
  Resistance Marker For Multiple Organisms

SEQ ID NO: 1908 - protein, 291 aa, Unknown; identical to SEQ ID NO: 437
  Resistance Marker For Multiple Organisms

SEQ ID NO: 1909 - protein, 286 aa, Unknown; identical to SEQ ID NO: 513
  Resistance Marker For Multiple Organisms

SEQ ID NO: 1910 - protein, 95 aa, Unknown
  Resistance Marker For Multiple Organisms
ALPGDARDTTTPASMAATLRKLLTSQRLSARSQRQLLQWMVDDRVAGPLIRSVLPAGWFIADKTGASERGARGIVALLGPNNKAERIVVIYLRDS

SEQ ID NO: 1911 - protein, 286 aa, Unknown
  Resistance Marker For Multiple Organisms
MRYIRLCIISLLAALPLVVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITVSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 1912 - protein, 286 aa, Unknown; identical to SEQ ID NO: 587
  Resistance Marker For Multiple Organisms

SEQ ID NO: 1913 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELRAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGTGAAPIEHWQR

SEQ ID NO: 1914 - protein, 286 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLREIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAALIEHWQR

SEQ ID NO: 1915 - protein, 286 aa, Unknown
  Resistance Marker For Multiple Organisms
MRYIRLCIISLLATLPLAVHASPQPLKQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMTATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 1916 - protein, 286 aa, Unknown
  Resistance Marker For Multiple Organisms
MRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAALTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPHNKAERIVVIYLRDTPASMAERNQQIAGIGAALIEHWQR

SEQ ID NO: 1917 - protein, 286 aa, Unknown
  Resistance Marker For Multiple Organisms
KRYIRLCIISLLATLPLAVHASPQPLEQIKLSESQLSGRVGMIEMDLASGRTLTAWRADERFPMMSTFKVVLCGAVLARVDAGDEQLERKIHYSQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 1918 - protein, 286 aa, Unknown; identical to SEQ ID NO: 549
  Resistance Marker For Multiple Organisms

SEQ ID NO: 1919 - protein, 279 aa, Unknown
  Resistance Marker For Multiple Organisms
MRYIRLCIISLLATLPLAVHASPQPLEQIKQSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGASKRGARGIVALLGPNNKAERIVVIYLRDTPASMAERNQQIAGIGAA

SEQ ID NO: 1920 - protein, 382 aa, Unknown
  Resistance Marker For Multiple Organisms
MQQRRAFALLTLGSLLLAPCTYASGEAPLTATVDGIIQPMLKEYRIPGIAVAVLKDGKAHYFNYGVANRESGQRVSEQTLFEIGSVSKTLTATLGAYAAVKGGFVLDDKVSQHAPWLKGSALDGVTMAELATYSAGGLPLQFPDKVDSNDKMQTYYRSWSPVYPAGTHRQYSNPSIGLFGHLAANSLGQPFEQLMSQTLLPKLGLHHTYIQVPESAMANYAYGYSKEDKPIRVTPGVLAAEAYGIKTGSADLLKFAEANMGYQGDALVKSAIALTHTGFYSVGEMTQGLGWESYDYPVTEQVLLAGNSPAVSLQANPVTRFAVPKAMGEQRLYNKTGSTGGFGAYVAFVPARGIAIVMLANRNYPIEARVKAAHAILSQLAE

SEQ ID NO: 1921 - protein, 382 aa, Unknown
  Resistance Marker For Multiple Organisms
MQQRRAFALLTLGSLLLAPCTYASGEAPLTVTVDGIIQPMLKAYRIPGMAVAVLKDGKAHYFNYGVANRESGQRVSEQTLFEIGSVSKTLTATLGAYAAVKGGFELDDKVSQHAPWLKGSAFDGVTMAELATYSAGGLPLQFPEEVDSNDKMRTYYRSWSPVYPAGTHRQYANTSIGLFGYLAANSLGQSFEQLMSQTLLPKLGLHHTYIQVPESAMANYAYGYSKEEKPIRVTPGMLAAEAYGIKTGSADLLKFAEANMGYQGDAAVKSAIALTHTGFYSVGDMTQGLGWESYDYPVTEQVLLADNSPAVSFQANPVTRFAVPKAMGEQRLYNKTGSTGGFGAYVAFVPARGIAIVMLANRNYPIEARVKAAHAILSQLAE

SEQ ID NO: 1922 - protein, 382 aa, Unknown; identical to SEQ ID NO: 716
  Resistance Marker For Multiple Organisms

SEQ ID NO: 1923 - protein, 5 aa, Unknown
  Resistance Marker For Multiple Organisms
DAEDK

SEQ ID NO: 1924 - protein, 11 aa, Unknown
  Resistance Marker For Multiple Organisms
GIIAALGPDGK

SEQ ID NO: 1925 - protein, 14 aa, Unknown
  Resistance Marker For Multiple Organisms
GSSGIIAALGPDGK

SEQ ID NO: 1926 - protein, 6 aa, Unknown
  Resistance Marker For Multiple Organisms
ILESFR

SEQ ID NO: 1927 - protein, 5 aa, Unknown
  Resistance Marker For Multiple Organisms
SGAGK

SEQ ID NO: 1928 - protein, 5 aa, Unknown
  Resistance Marker For Multiple Organisms
SGTGK

SEQ ID NO: 1929 - protein, 5 aa, Unknown
  Resistance Marker For Multiple Organisms
AALLR

SEQ ID NO: 1930 - protein, 13 aa, Unknown
  Resistance Marker For Multiple Organisms
ADSIINGNGSDSK

SEQ ID NO: 1931 - protein, 11 aa, Unknown
  Resistance Marker For Multiple Organisms
ADSIINGSDNK

SEQ ID NO: 1932 - protein, 5 aa, Unknown
  Resistance Marker For Multiple Organisms
AELLR

SEQ ID NO: 1933 - protein, 11 aa, Unknown
  Resistance Marker For Multiple Organisms
ALQQAISLTHK

SEQ ID NO: 1934 - protein, 17 aa, Unknown
  Resistance Marker For Multiple Organisms
AVHVSPGQLDAEAYGVK

SEQ ID NO: 1935 - protein, 7 aa, Unknown
  Resistance Marker For Multiple Organisms
DYACGYR

SEQ ID NO: 1936 - protein, 7 aa, Unknown
  Resistance Marker For Multiple Organisms
DYALGYR

SEQ ID NO: 1937 - protein, 6 aa, Unknown
  Resistance Marker For Multiple Organisms
EDKPIR

SEQ ID NO: 1938 - protein, 20 aa, Unknown
  Resistance Marker For Multiple Organisms
EGKPVHASPGQLDAEAYGVK

SEQ ID NO: 1939 - protein, 20 aa, Unknown
  Resistance Marker For Multiple Organisms
EGKPVHGSPGQLDAEAYGVK

SEQ ID NO: 1940 - protein, 20 aa, Unknown
  Resistance Marker For Multiple Organisms
EGKPVHVSPEQLDAEAYGVK

SEQ ID NO: 1941 - protein, 11 aa, Unknown
  Resistance Marker For Multiple Organisms
EGKPVHVSPGK

SEQ ID NO: 1942 - protein, 20 aa, Unknown
  Resistance Marker For Multiple Organisms
EGKPVHVSPGQFDAEAYGVK

SEQ ID NO: 1943 - protein, 20 aa, Unknown
  Resistance Marker For Multiple Organisms
EGKPVHVSPGQLDAEAYCVK

SEQ ID NO: 1944 - protein, 20 aa, Unknown
  Resistance Marker For Multiple Organisms
EGKPVHVSPGQLDAEAYGVK

SEQ ID NO: 1945 - protein, 20 aa, Unknown
  Resistance Marker For Multiple Organisms
EGKPVHVSPGQLDAGAYGVK

SEQ ID NO: 1946 - protein, 20 aa, Unknown
  Resistance Marker For Multiple Organisms
EGKPVHVSPGQLNAEAYGVK

SEQ ID NO: 1947 - protein, 11 aa, Unknown
  Resistance Marker For Multiple Organisms
EGKPVHVSPGR

SEQ ID NO: 1948 - protein, 20 aa, Unknown
  Resistance Marker For Multiple Organisms
EGKPVHVTPGQLDAEAYGVK

SEQ ID NO: 1949 - protein, 20 aa, Unknown
  Resistance Marker For Multiple Organisms
EGKPVYVSPGQLDAEAYGVK

SEQ ID NO: 1950 - protein, 19 aa, Unknown
  Resistance Marker For Multiple Organisms
ESGAGVSEQTLFEIGSVSK

SEQ ID NO: 1951 - protein, 19 aa, Unknown
  Resistance Marker For Multiple Organisms
ESGASVSEQTLFDIGSVSK

SEQ ID NO: 1952 - protein, 19 aa, Unknown
  Resistance Marker For Multiple Organisms
ESGASVSEQTLFEIGSVSK

SEQ ID NO: 1953 - protein, 7 aa, Unknown
  Resistance Marker For Multiple Organisms
FSDPVTK

SEQ ID NO: 1954 - protein, 14 aa, Unknown
  Resistance Marker For Multiple Organisms
FYQNWQPQWAPGAK

SEQ ID NO: 1955 - protein, 14 aa, Unknown
  Resistance Marker For Multiple Organisms
FYQNWQPQWTPGAK

SEQ ID NO: 1956 - protein, 6 aa, Unknown
  Resistance Marker For Multiple Organisms
IPDDVR

SEQ ID NO: 1957 - protein, 7 aa, Unknown
  Resistance Marker For Multiple Organisms
LAHTWIK

SEQ ID NO: 1958 - protein, 14 aa, Unknown
  Resistance Marker For Multiple Organisms
LAHTWITVPENEQK

SEQ ID NO: 1959 - protein, 14 aa, Unknown
  Resistance Marker For Multiple Organisms
LAHTWITVPQSEQK

SEQ ID NO: 1960 - protein, 9 aa, Unknown
  Resistance Marker For Multiple Organisms
LDAEAYGVK

SEQ ID NO: 1961 - protein, 15 aa, Unknown
  Resistance Marker For Multiple Organisms
LLHLATYTAGGLPLK

SEQ ID NO: 1962 - protein, 21 aa, Unknown
  Resistance Marker For Multiple Organisms
LLHLATYTAGGLPLQFPDDVR

SEQ ID NO: 1963 - protein, 16 aa, Unknown
  Resistance Marker For Multiple Organisms
LYANSSIGLFAALAVK

SEQ ID NO: 1964 - protein, 16 aa, Unknown
  Resistance Marker For Multiple Organisms
LYANSSIGLFGALVVK

SEQ ID NO: 1965 - protein, 16 aa, Unknown
  Resistance Marker For Multiple Organisms
LYANSSIGLFGELAVK

SEQ ID NO: 1966 - protein, 16 aa, Unknown
  Resistance Marker For Multiple Organisms
LYANSSIGLFGTLAVK

SEQ ID NO: 1967 - protein, 16 aa, Unknown
  Resistance Marker For Multiple Organisms
LYANSSIGLFSALAVK

SEQ ID NO: 1968 - protein, 16 aa, Unknown
  Resistance Marker For Multiple Organisms
LYSNSSIGLFGALAVK

SEQ ID NO: 1969 - protein, 7 aa, Unknown
  Resistance Marker For Multiple Organisms
NYAWGYR

SEQ ID NO: 1970 - protein, 7 aa, Unknown
  Resistance Marker For Multiple Organisms
NYPIPAR

SEQ ID NO: 1971 - protein, 7 aa, Unknown
  Resistance Marker For Multiple Organisms
NYPNEAR

SEQ ID NO: 1972 - protein, 7 aa, Unknown
  Resistance Marker For Multiple Organisms
NYPNPVR

SEQ ID NO: 1973 - protein, 19 aa, Unknown
  Resistance Marker For Multiple Organisms
SICCALLLTASFSTFAAAK

SEQ ID NO: 1974 - protein, 19 aa, Unknown
  Resistance Marker For Multiple Organisms
SICCALLLTASFSTFAATK

SEQ ID NO: 1975 - protein, 19 aa, Unknown
  Resistance Marker For Multiple Organisms
SLCCALLLTAPLSTFAAAK

SEQ ID NO: 1976 - protein, 19 aa, Unknown
  Resistance Marker For Multiple Organisms
SLCCALLLTASFSTFASAK

SEQ ID NO: 1977 - protein, 19 aa, Unknown
  Resistance Marker For Multiple Organisms
SLCCALLLTASLSTFAAAK

SEQ ID NO: 1978 - protein, 8 aa, Unknown
  Resistance Marker For Multiple Organisms
SNVTDMAR

SEQ ID NO: 1979 - protein, 7 aa, Unknown
  Resistance Marker For Multiple Organisms
SYPNPIR

SEQ ID NO: 1980 - protein, 19 aa, Unknown
  Resistance Marker For Multiple Organisms
TALLHFYQNWQPQWAPGAK

SEQ ID NO: 1981 - protein, 11 aa, Unknown
  Resistance Marker For Multiple Organisms
TDSIINGSDSK

SEQ ID NO: 1982 - protein, 13 aa, Unknown
  Resistance Marker For Multiple Organisms
TFIGVLGGDAIAR

SEQ ID NO: 1983 - protein, 13 aa, Unknown
  Resistance Marker For Multiple Organisms
TFNGVLGGDCIAR

SEQ ID NO: 1984 - protein, 13 aa, Unknown
  Resistance Marker For Multiple Organisms
TFNGVLGGEAIAR

SEQ ID NO: 1985 - protein, 17 aa, Unknown
  Resistance Marker For Multiple Organisms
TGSTVGFGSYVAFVPEK

SEQ ID NO: 1986 - protein, 17 aa, Unknown
  Resistance Marker For Multiple Organisms
TGYTGGFGSYVAFVPEK

SEQ ID NO: 1987 - protein, 12 aa, Unknown
  Resistance Marker For Multiple Organisms
TLQQGIELAQSR

SEQ ID NO: 1988 - protein, 11 aa, Unknown
  Resistance Marker For Multiple Organisms
TSSADLLAFVK

SEQ ID NO: 1989 - protein, 8 aa, Unknown
  Resistance Marker For Multiple Organisms
TSSADLLR

SEQ ID NO: 1990 - protein, 8 aa, Unknown
  Resistance Marker For Multiple Organisms
TYYFTWGK

SEQ ID NO: 1991 - protein, 17 aa, Unknown
  Resistance Marker For Multiple Organisms
VAALPAVEVNPPAPAVK

SEQ ID NO: 1992 - protein, 19 aa, Unknown
  Resistance Marker For Multiple Organisms
VAFAALPAVEVNPPAPAVK

SEQ ID NO: 1993 - protein, 19 aa, Unknown
  Resistance Marker For Multiple Organisms
VALAAIPAVEVNPPAPAVK

SEQ ID NO: 1994 - protein, 19 aa, Unknown
  Resistance Marker For Multiple Organisms
VALAALHTVEVNPPAPAVK

SEQ ID NO: 1995 - protein, 19 aa, Unknown
  Resistance Marker For Multiple Organisms
VALAALPAVEINPPAPAVK

SEQ ID NO: 1996 - protein, 19 aa, Unknown
  Resistance Marker For Multiple Organisms
VALAALPTVEVNPPAPAVK

SEQ ID NO: 1997 - protein, 15 aa, Unknown
  Resistance Marker For Multiple Organisms
VAPAVEVNPPAPAVK

SEQ ID NO: 1998 - protein, 6 aa, Unknown
  Resistance Marker For Multiple Organisms
VEAYWR

SEQ ID NO: 1999 - protein, 12 aa, Unknown
  Resistance Marker For Multiple Organisms
VILEANPTAAPR

SEQ ID NO: 2000 - protein, 7 aa, Unknown
  Resistance Marker For Multiple Organisms
VPQSEQK

SEQ ID NO: 2001 - protein, 12 aa, Unknown
  Resistance Marker For Multiple Organisms
VSLEANPTAAPR

SEQ ID NO: 2002 - protein, 10 aa, Unknown
  Resistance Marker For Multiple Organisms
WIQVNMDASR

SEQ ID NO: 2003 - protein, 10 aa, Unknown
  Resistance Marker For Multiple Organisms
WVQANMDASR

SEQ ID NO: 2004 - protein, 10 aa, Unknown
  Resistance Marker For Multiple Organisms
WVQVNMDASR

SEQ ID NO: 2005 - protein, 18 aa, Unknown
  Resistance Marker For Multiple Organisms
YAAALLLTASFSTFAAAK

SEQ ID NO: 2006 - protein, 8 aa, Unknown
  Resistance Marker For Multiple Organisms
YLPELTGK

SEQ ID NO: 2007 - protein, 8 aa, Unknown
  Resistance Marker For Multiple Organisms
YWSELTGK

SEQ ID NO: 2008 - protein, 5 aa, Unknown
  Resistance Marker For Multiple Organisms
AAGIR

SEQ ID NO: 2009 - protein, 9 aa, Unknown
  Resistance Marker For Multiple Organisms
AGADVASLR

SEQ ID NO: 2010 - protein, 12 aa, Unknown
  Resistance Marker For Multiple Organisms
AGLPASWVVGDK

SEQ ID NO: 2011 - protein, 12 aa, Unknown
  Resistance Marker For Multiple Organisms
AGLPTSWTAGDK

SEQ ID NO: 2012 - protein, 12 aa, Unknown
  Resistance Marker For Multiple Organisms
AGLPTSWTVGDR

SEQ ID NO: 2013 - protein, 12 aa, Unknown
  Resistance Marker For Multiple Organisms
AGLPTSWVVGDK

SEQ ID NO: 2014 - protein, 5 aa, Unknown
  Resistance Marker For Multiple Organisms
AGMPK

SEQ ID NO: 2015 - protein, 8 aa, Unknown
  Resistance Marker For Multiple Organisms
AIGDDTFR

SEQ ID NO: 2016 - protein, 8 aa, Unknown
  Resistance Marker For Multiple Organisms
AIGDNTFR

SEQ ID NO: 2017 - protein, 9 aa, Unknown
  Resistance Marker For Multiple Organisms
AMAVAAVLK

SEQ ID NO: 2018 - protein, 15 aa, Unknown
  Resistance Marker For Multiple Organisms
APLILVIYFTQPQPK

SEQ ID NO: 2019 - protein, 15 aa, Unknown
  Resistance Marker For Multiple Organisms
APLILVTYFTQPEQK

SEQ ID NO: 2020 - protein, 19 aa, Unknown
  Resistance Marker For Multiple Organisms
APLILVTYFTQPQPNAESR

SEQ ID NO: 2021 - protein, 15 aa, Unknown
  Resistance Marker For Multiple Organisms
APLVLVTYFTQPEPK

SEQ ID NO: 2022 - protein, 19 aa, Unknown
  Resistance Marker For Multiple Organisms
APLVLVTYFTQPQQNAENR

SEQ ID NO: 2023 - protein, 18 aa, Unknown
  Resistance Marker For Multiple Organisms
APLVLVTYFTQPQQNAER

SEQ ID NO: 2024 - protein, 15 aa, Unknown
  Resistance Marker For Multiple Organisms
APLVLVTYFTQSEPK

SEQ ID NO: 2025 - protein, 8 aa, Unknown
  Resistance Marker For Multiple Organisms
AQLVAWLK

SEQ ID NO: 2026 - protein, 8 aa, Unknown
  Resistance Marker For Multiple Organisms
AQLVMWLK

SEQ ID NO: 2027 - protein, 13 aa, Unknown
  Resistance Marker For Multiple Organisms
ASDLVNYNPIAEK

SEQ ID NO: 2028 - protein, 7 aa, Unknown
  Resistance Marker For Multiple Organisms
CWVVGDK

SEQ ID NO: 2029 - protein, 8 aa, Unknown
  Resistance Marker For Multiple Organisms
DFLAAAAK

SEQ ID NO: 2030 - protein, 8 aa, Unknown
  Resistance Marker For Multiple Organisms
DILASAAK

SEQ ID NO: 2031 - protein, 6 aa, Unknown
  Resistance Marker For Multiple Organisms
DLLSQR

SEQ ID NO: 2032 - protein, 8 aa, Unknown
  Resistance Marker For Multiple Organisms
DNTQVLYR

SEQ ID NO: 2033 - protein, 6 aa, Unknown
  Resistance Marker For Multiple Organisms
DTTTAR

SEQ ID NO: 2034 - protein, 13 aa, Unknown
  Resistance Marker For Multiple Organisms
DTTTPLAMAQALR

SEQ ID NO: 2035 - protein, 13 aa, Unknown
  Resistance Marker For Multiple Organisms
DTTTPLAMAQSLR

SEQ ID NO: 2036 - protein, 13 aa, Unknown
  Resistance Marker For Multiple Organisms
DTTTPLAMAQTLR

SEQ ID NO: 2037 - protein, 8 aa, Unknown
  Resistance Marker For Multiple Organisms
DVLAAAAR

SEQ ID NO: 2038 - protein, 8 aa, Unknown
  Resistance Marker For Multiple Organisms
EIGDETFR

SEQ ID NO: 2039 - protein, 8 aa, Unknown
  Resistance Marker For Multiple Organisms
EQLVTWLK

SEQ ID NO: 2040 - protein, 6 aa, Unknown
  Resistance Marker For Multiple Organisms
GLLSQR

SEQ ID NO: 2041 - protein, 8 aa, Unknown
  Resistance Marker For Multiple Organisms
GNTTGAAR

SEQ ID NO: 2042 - protein, 15 aa, Unknown
  Resistance Marker For Multiple Organisms
GNTTGSASIQAGLPK

SEQ ID NO: 2043 - protein, 9 aa, Unknown
  Resistance Marker For Multiple Organisms
HDVLASAAK

SEQ ID NO: 2044 - protein, 9 aa, Unknown
  Resistance Marker For Multiple Organisms
HDVLASAAR

SEQ ID NO: 2045 - protein, 13 aa, Unknown
  Resistance Marker For Multiple Organisms
HLTLGSALGETQR

SEQ ID NO: 2046 - protein, 11 aa, Unknown
  Resistance Marker For Multiple Organisms
LAELEQQSGGR

SEQ ID NO: 2047 - protein, 6 aa, Unknown
  Resistance Marker For Multiple Organisms
LAGLER

SEQ ID NO: 2048 - protein, 17 aa, Unknown
  Resistance Marker For Multiple Organisms
LDGTEPTLNTAIPGDPR

SEQ ID NO: 2049 - protein, 17 aa, Unknown
  Resistance Marker For Multiple Organisms
LGVALIDTADNAQTLYR

SEQ ID NO: 2050 - protein, 17 aa, Unknown
  Resistance Marker For Multiple Organisms
LGVALIDTADNTHVLYR

SEQ ID NO: 2051 - protein, 9 aa, Unknown
  Resistance Marker For Multiple Organisms
LGVALIDTK

SEQ ID NO: 2052 - protein, 21 aa, Unknown
  Resistance Marker For Multiple Organisms
LGVALINTADNSQILYLADER

SEQ ID NO: 2053 - protein, 21 aa, Unknown
  Resistance Marker For Multiple Organisms
LGVALINTADNSQILYVADER

SEQ ID NO: 2054 - protein, 13 aa, Unknown
  Resistance Marker For Multiple Organisms
LGVALINTADNSR

SEQ ID NO: 2055 - protein, 17 aa, Unknown
  Resistance Marker For Multiple Organisms
LGVALINTADNTQTLYR

SEQ ID NO: 2056 - protein, 21 aa, Unknown
  Resistance Marker For Multiple Organisms
LGVAQINTADNSQILYVADER

SEQ ID NO: 2057 - protein, 17 aa, Unknown
  Resistance Marker For Multiple Organisms
LGVPLIDTADNTQVLYR

SEQ ID NO: 2058 - protein, 10 aa, Unknown
  Resistance Marker For Multiple Organisms
LIAHLGGPGK

SEQ ID NO: 2059 - protein, 16 aa, Unknown
  Resistance Marker For Multiple Organisms
LIAQLGGQGGVTAFAR

SEQ ID NO: 2060 - protein, 16 aa, Unknown
  Resistance Marker For Multiple Organisms
LISHVGGPASVTAFAR

SEQ ID NO: 2061 - protein, 6 aa, Unknown
  Resistance Marker For Multiple Organisms
LLLNQR

SEQ ID NO: 2062 - protein, 13 aa, Unknown
  Resistance Marker For Multiple Organisms
NLTLGNALGDTQR

SEQ ID NO: 2063 - protein, 13 aa, Unknown
  Resistance Marker For Multiple Organisms
NLTLGSALGETQR

SEQ ID NO: 2064 - protein, 6 aa, Unknown
  Resistance Marker For Multiple Organisms
NVLSQK

SEQ ID NO: 2065 - protein, 8 aa, Unknown
  Resistance Marker For Multiple Organisms
QLGDDTFR

SEQ ID NO: 2066 - protein, 12 aa, Unknown
  Resistance Marker For Multiple Organisms
SDLVNYSPIAEK

SEQ ID NO: 2067 - protein, 11 aa, Unknown
  Resistance Marker For Multiple Organisms
SESEPSLLNQR

SEQ ID NO: 2068 - protein, 5 aa, Unknown
  Resistance Marker For Multiple Organisms
SETQK

SEQ ID NO: 2069 - protein, 8 aa, Unknown
  Resistance Marker For Multiple Organisms
SLGDESFR

SEQ ID NO: 2070 - protein, 13 aa, Unknown
  Resistance Marker For Multiple Organisms
SSDLINYNPIAEK

SEQ ID NO: 2071 - protein, 13 aa, Unknown
  Resistance Marker For Multiple Organisms
SSDLINYNPITEK

SEQ ID NO: 2072 - protein, 7 aa, Unknown
  Resistance Marker For Multiple Organisms
SWGVGDK

SEQ ID NO: 2073 - protein, 14 aa, Unknown
  Resistance Marker For Multiple Organisms
TELTLNTAIPGDPR

SEQ ID NO: 2074 - protein, 14 aa, Unknown
  Resistance Marker For Multiple Organisms
TEPTLNSAIPGDPR

SEQ ID NO: 2075 - protein, 14 aa, Unknown
  Resistance Marker For Multiple Organisms
TEPTQNTAIPGDPR

SEQ ID NO: 2076 - protein, 14 aa, Unknown
  Resistance Marker For Multiple Organisms
TEQTLNTAIPGDPR

SEQ ID NO: 2077 - protein, 14 aa, Unknown
  Resistance Marker For Multiple Organisms
TESTLNTAIPGDPR

SEQ ID NO: 2078 - protein, 14 aa, Unknown
  Resistance Marker For Multiple Organisms
TETTLNTAIPGDPR

SEQ ID NO: 2079 - protein, 18 aa, Unknown
  Resistance Marker For Multiple Organisms
TGSCDYGTTNDIAVIWPK

SEQ ID NO: 2080 - protein, 18 aa, Unknown
  Resistance Marker For Multiple Organisms
TGSCGYGTTNDIAVIWPK

SEQ ID NO: 2081 - protein, 20 aa, Unknown
  Resistance Marker For Multiple Organisms
TGSGDYGTTNDIAVIWPEGR

SEQ ID NO: 2082 - protein, 20 aa, Unknown
  Resistance Marker For Multiple Organisms
TGSGGYGTTNDIAVIWPEGR

SEQ ID NO: 2083 - protein, 20 aa, Unknown
  Resistance Marker For Multiple Organisms
TGSGGYGTTNDIAVIWPQGR

SEQ ID NO: 2084 - protein, 8 aa, Unknown
  Resistance Marker For Multiple Organisms
TIGDDTFR

SEQ ID NO: 2085 - protein, 8 aa, Unknown
  Resistance Marker For Multiple Organisms
TQLVTWLK

SEQ ID NO: 2086 - protein, 17 aa, Unknown
  Resistance Marker For Multiple Organisms
VEIKPSDLINYNPIAEK

SEQ ID NO: 2087 - protein, 17 aa, Unknown
  Resistance Marker For Multiple Organisms
VEIKPSDLVNYNPIAEK

SEQ ID NO: 2088 - protein, 8 aa, Unknown
  Resistance Marker For Multiple Organisms
VIGDDTFR

SEQ ID NO: 2089 - protein, 5 aa, Unknown
  Resistance Marker For Multiple Organisms
VLSQK

SEQ ID NO: 2090 - protein, 9 aa, Unknown
  Resistance Marker For Multiple Organisms
VMAAAALLK

SEQ ID NO: 2091 - protein, 15 aa, Unknown
  Resistance Marker For Multiple Organisms
VMAAAAVLEQSETQK

SEQ ID NO: 2092 - protein, 14 aa, Unknown
  Resistance Marker For Multiple Organisms
WAKPSGAVGDVAQR

SEQ ID NO: 2093 - protein, 8 aa, Unknown
  Resistance Marker For Multiple Organisms
EIGDNVTR

SEQ ID NO: 2094 - protein, 11 aa, Unknown
  Resistance Marker For Multiple Organisms
GIVALLGPHNK

SEQ ID NO: 2095 - protein, 12 aa, Unknown
  Resistance Marker For Multiple Organisms
HLADGMTVGELR

SEQ ID NO: 2096 - protein, 17 aa, Unknown
  Resistance Marker For Multiple Organisms
IHYSQQDLVDYSPVSEK

SEQ ID NO: 2097 - protein, 19 aa, Unknown
  Resistance Marker For Multiple Organisms
AFALLTLGSLLLAPCTYAR

SEQ ID NO: 2098 - protein, 14 aa, Unknown
  Resistance Marker For Multiple Organisms
ATPGVLAAEAYGIK

SEQ ID NO: 2099 - protein, 6 aa, Unknown
  Resistance Marker For Multiple Organisms
EDKPVR

SEQ ID NO: 2100 - protein, 6 aa, Unknown
  Resistance Marker For Multiple Organisms
EEKPIR

SEQ ID NO: 2101 - protein, 15 aa, Unknown
  Resistance Marker For Multiple Organisms
FAEANMGYQGDAAVK

SEQ ID NO: 2102 - protein, 15 aa, Unknown
  Resistance Marker For Multiple Organisms
FAEANMGYQGDALVK

SEQ ID NO: 2103 - protein, 15 aa, Unknown
  Resistance Marker For Multiple Organisms
FTEANMGYQGDAALK

SEQ ID NO: 2104 - protein, 15 aa, Unknown
  Resistance Marker For Multiple Organisms
FVEANMGYQGDAALK

SEQ ID NO: 2105 - protein, 18 aa, Unknown
  Resistance Marker For Multiple Organisms
GEAPLTAAVDGIIQPMLK

SEQ ID NO: 2106 - protein, 8 aa, Unknown
  Resistance Marker For Multiple Organisms
GGFVLDDK

SEQ ID NO: 2107 - protein, 12 aa, Unknown
  Resistance Marker For Multiple Organisms
HWSPVYPAGTHR

SEQ ID NO: 2108 - protein, 10 aa, Unknown
  Resistance Marker For Multiple Organisms
IPGIAVAVLK

SEQ ID NO: 2109 - protein, 9 aa, Unknown
  Resistance Marker For Multiple Organisms
LMSQTLLPK

SEQ ID NO: 2110 - protein, 6 aa, Unknown
  Resistance Marker For Multiple Organisms
MQTYYR

SEQ ID NO: 2111 - protein, 6 aa, Unknown
  Resistance Marker For Multiple Organisms
VDSNDK

SEQ ID NO: 2112 - protein, 9 aa, Unknown
  Resistance Marker For Multiple Organisms
VSHHAPWLK

SEQ ID NO: 2113 - protein, 14 aa, Unknown
  Resistance Marker For Multiple Organisms
VTPGMLAAEAYGIK

SEQ ID NO: 2114 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2115 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2116 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQLAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2117 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMNDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2118 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2119 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2120 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGSRNDIGFFKAQERDYAVAVYTTAPKLSAVERDELVASVGQVITQLILSTDK

SEQ ID NO: 2121 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 2122 - protein, 287 aa, Unknown
  Resistance Marker For Multiple Organisms
MRFIHALLLAGTAHSAYASEKLTFKTDLEKLEREKAAQIGVAIVDPQGEIVAGHRTAQRFAMCSTFKFPLAALVFERIDSGTERGDRKLSYGPDMIVEWSPATERFLASGHMTVLEAAQAAVQLCDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2123 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMNDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2124 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKESEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2125 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 2126 - protein, 287 aa, Unknown
  Resistance Marker For Multiple Organisms
MRFIHALLLAGIAHSAYASEKLTFKTDLEKLEREKAAEIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2127 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 2128 - protein, 287 aa, Unknown
  Resistance Marker For Multiple Organisms
MRFIHALLLAGIAHSAYASEKLTFKTDLEKLEREKAAQIGVAIVDPQGEIVAGHRTAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2129 - protein, 287 aa, Unknown
  Resistance Marker For Multiple Organisms
MRFIHALLLAGIAHSAYASEKLTFKTDLEKLEREKAAQIGVAIVDPQGEIVAGHRTAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 2130 - protein, 287 aa, Unknown
  Resistance Marker For Multiple Organisms
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGACANGARNDIGFFKAQERDYAVAVYTTAPKLSAVERDELVASVGQVITQLILSTDK

SEQ ID NO: 2131 - protein, 20 aa, Unknown
  Resistance Marker For Multiple Organisms
AAEIGVAIVDPQGEIVAGHR

SEQ ID NO: 2132 - protein, 20 aa, Unknown
  Resistance Marker For Multiple Organisms
AAQIGVAIVDPQGEIVAGHR

SEQ ID NO: 2133 - protein, 5 aa, Unknown
  Resistance Marker For Multiple Organisms
AGFPK

SEQ ID NO: 2134 - protein, 10 aa, Unknown
  Resistance Marker For Multiple Organisms
DTTTPIAMAR

SEQ ID NO: 2135 - protein, 7 aa, Unknown
  Resistance Marker For Multiple Organisms
DWVVGEK

SEQ ID NO: 2136 - protein, 12 aa, Unknown
  Resistance Marker For Multiple Organisms
DYAVAVYTTAPK

SEQ ID NO: 2137 - protein, 13 aa, Unknown
  Resistance Marker For Multiple Organisms
EIGGPAAMTQYFR

SEQ ID NO: 2138 - protein, 13 aa, Unknown
  Resistance Marker For Multiple Organisms
EPEMGDNTPGDLR

SEQ ID NO: 2139 - protein, 13 aa, Unknown
  Resistance Marker For Multiple Organisms
EPEMNDNTPGDLR

SEQ ID NO: 2140 - protein, 13 aa, Unknown
  Resistance Marker For Multiple Organisms
EPEMSDNTPGDLR

SEQ ID NO: 2141 - protein, 13 aa, Unknown
  Resistance Marker For Multiple Organisms
ESEMSDNTPGDLR

SEQ ID NO: 2142 - protein, 8 aa, Unknown
  Resistance Marker For Multiple Organisms
FAMCSTFK

SEQ ID NO: 2143 - protein, 19 aa, Unknown
  Resistance Marker For Multiple Organisms
FIHALLLAGIAHSAYASEK

SEQ ID NO: 2144 - protein, 19 aa, Unknown
  Resistance Marker For Multiple Organisms
FIHALLLAGTAHSAYASEK

SEQ ID NO: 2145 - protein, 10 aa, Unknown
  Resistance Marker For Multiple Organisms
FPLAALVFER

SEQ ID NO: 2146 - protein, 7 aa, Unknown
  Resistance Marker For Multiple Organisms
IDSGTER

SEQ ID NO: 2147 - protein, 7 aa, Unknown
  Resistance Marker For Multiple Organisms
IGDSVSR

SEQ ID NO: 2148 - protein, 6 aa, Unknown
  Resistance Marker For Multiple Organisms
LSAVER

SEQ ID NO: 2149 - protein, 17 aa, Unknown
  Resistance Marker For Multiple Organisms
LSYGPDMIVEWSPATER

SEQ ID NO: 2150 - protein, 10 aa, Unknown
  Resistance Marker For Multiple Organisms
LSYGPDMIVK

SEQ ID NO: 2151 - protein, 7 aa, Unknown
  Resistance Marker For Multiple Organisms
NDIGFFK

SEQ ID NO: 2152 - protein, 5 aa, Unknown
  Resistance Marker For Multiple Organisms
TDLEK

SEQ ID NO: 2153 - protein, 9 aa, Unknown
  Resistance Marker For Multiple Organisms
TGACANGAR

SEQ ID NO: 2154 - protein, 9 aa, Unknown
  Resistance Marker For Multiple Organisms
TGTCANGAR

SEQ ID NO: 2155 - protein, 9 aa, Unknown
  Resistance Marker For Multiple Organisms
TGTCANGGR

SEQ ID NO: 2156 - protein, 9 aa, Unknown
  Resistance Marker For Multiple Organisms
TGTCANGSR

SEQ ID NO: 2157 - protein, 17 aa, Unknown
  Resistance Marker For Multiple Organisms
VLYGGALTSTSTHTIER

SEQ ID NO: 2158 - protein, 13 aa, Unknown
  Resistance Marker For Multiple Organisms
WLIGNQTGDATLR

SEQ ID NO: 2159 - protein, 7 aa, Unknown
  Resistance Marker For Multiple Organisms
WSPATER

SEQ ID NO: 2160 - protein, 12 aa, Unknown
  Resistance Marker For Multiple Organisms
ANQAFLPASTFK

SEQ ID NO: 2161 - protein, 7 aa, Unknown
  Resistance Marker For Multiple Organisms
DEHQVFK

SEQ ID NO: 2162 - protein, 9 aa, Unknown
  Resistance Marker For Multiple Organisms
DHNLITAMK

SEQ ID NO: 2163 - protein, 7 aa, Unknown
  Resistance Marker For Multiple Organisms
DIATWNR

SEQ ID NO: 2164 - protein, 14 aa, Unknown
  Resistance Marker For Multiple Organisms
IPNSLIALDLGVVK

SEQ ID NO: 2165 - protein, 11 aa, Unknown
  Resistance Marker For Multiple Organisms
ISATEQISFLR

SEQ ID NO: 2166 - protein, 14 aa, Unknown
  Resistance Marker For Multiple Organisms
QAMLTEANGDYIIR

SEQ ID NO: 2167 - protein, 9 aa, Unknown
  Resistance Marker For Multiple Organisms
QQGFTNNLK

SEQ ID NO: 2168 - protein, 12 aa, Unknown
  Resistance Marker For Multiple Organisms
SQGVVVLWNENK

SEQ ID NO: 2169 - protein, 10 aa, Unknown
  Resistance Marker For Multiple Organisms
SWNAHFTEHK

SEQ ID NO: 2170 - protein, 21 aa, Unknown
  Resistance Marker For Multiple Organisms
VLALSAVFLVASIIGMPAVAK

SEQ ID NO: 2171 - protein, 12 aa, Unknown
  Resistance Marker For Multiple Organisms
YSVVPVYQEFAR

The invention claimed is:

1. A method of detecting a TEM protein in a sample, comprising:
subjecting the sample to MS/MS spectrometry in MRM mode and detecting whether one or more TEM fragments selected from the group consisting of SEQ ID NOS: 166-230, 232-257, 259-261, 1923, 1927, and 1928 is present, wherein detection of any of the TEM fragments by the MRM mass spectrometry indicates the presence of TEM protein in the sample.

2. The detection method according to claim 1, further comprising, before performing MS/MS spectrometry in MRM mode, digesting proteins to produce peptides in the sample.

3. The detection method according to claim 2, wherein the digestion is performed by an enzyme.

4. The detection method according to claim 3, wherein the enzyme is trypsin.

5. The detection method according to claim 1, wherein the one or more TEM fragments is selected from the group consisting of SEQ ID NOS: 166-174, 180, 181, 186-203, 212-217, 219, 220, 223-230, 241-243, 250-255, 259-261, 1927, and 1928.

* * * * *